US012509668B2

(12) United States Patent
Beese et al.

(10) Patent No.: US 12,509,668 B2
(45) Date of Patent: Dec. 30, 2025

(54) ENGINEERED POLYMERASES AND METHODS OF USING THE SAME

(71) Applicant: DUKE UNIVERSITY, Durham, NC (US)

(72) Inventors: Lorena S. Beese, Durham, NC (US); You Wang, Durham, NC (US); Yuqian Shi, Durham, NC (US)

(73) Assignee: DUKE UNIVERSITY, Durham, NC (US)

( * ) Notice: Subject to any disclaimer, the term of this patent is extended or adjusted under 35 U.S.C. 154(b) by 485 days.

(21) Appl. No.: 18/021,270

(22) PCT Filed: Jan. 26, 2021

(86) PCT No.: PCT/US2021/015129

§ 371 (c)(1),
(2) Date: Feb. 14, 2023

(87) PCT Pub. No.: WO2022/046162

PCT Pub. Date: Mar. 3, 2022

(65) Prior Publication Data

US 2024/0052325 A1 Feb. 15, 2024

Related U.S. Application Data

(60) Provisional application No. 63/071,493, filed on Aug. 28, 2020.

(51) Int. Cl.
*C12N 9/12* (2006.01)
*C12Q 1/686* (2018.01)

(52) U.S. Cl.
CPC ........... *C12N 9/1252* (2013.01); *C12Q 1/686* (2013.01); *C12Y 207/07007* (2013.01); *C07K 2319/92* (2013.01)

(58) Field of Classification Search
None
See application file for complete search history.

(56) References Cited

U.S. PATENT DOCUMENTS

| | | | |
|---|---|---|---|
| 5,773,258 | A | 6/1998 | Birch et al. |
| 6,183,998 | B1 | 2/2001 | Ivanov et al. |
| 9,416,352 | B2 | 8/2016 | Kwon et al. |
| 2004/0091966 | A1 | 5/2004 | Zeidler et al. |
| 2008/0227159 | A1 | 9/2008 | Hogrefe et al. |
| 2011/0138502 | A1 | 6/2011 | Raab |
| 2012/0135472 | A1 | 5/2012 | Kwon et al. |
| 2016/0264962 | A1 | 9/2016 | Katzen et al. |

FOREIGN PATENT DOCUMENTS

| | | |
|---|---|---|
| WO | 03/054139 | 7/2003 |
| WO | 2008/083393 | 7/2008 |

OTHER PUBLICATIONS

International Search Report and Written Opinion for PCT/US21/15129. Mailed Apr. 8, 2021. 8 pages.
Cambon-Bonavita et al., Cloning, expression, and characterization of DNA polymerase I from the hyperthermophilic archaea Thermococcus fumicolans. Extremophiles. Aug. 2000;4(4):215-25.
Zeidler et al., Temperature-sensitive control of protein activity by conditionally splicing inteins. Nat Biotechnol. Jul. 2004;22(7):871-6.
GenBank: AAB85157.1 ribonucleotide reductase, large subunit [Methanothermobacter thermautotrophicus str. Delta H] Jan. 30, 2014. Retrieved Mar. 27, 2024. 2 pages.
GenBank: AAG20316.1 MCM / cell division control protein 21 [Halobacterium salinarum NRC-1] Mar. 1, 2021. Retrieved Mar. 27, 2024. 2 pages.
GenBank: AAR38923.1 NEQ068 [Nanoarchaeum equitans Kin4-M] Apr. 7, 2021. Retrieved Mar. 27, 2024. 2 pages.
GenBank: AAR39369.1 NEQ528 [Nanoarchaeum equitans Kin4-M] Apr. 7, 2021. Retrieved Mar. 27, 2024. 2 pages.
GenBank: AAX38543.1 mini-intein, partial [Cryptococcus neoformans var. grubii] Jul. 26, 2016. Retrieved Mar. 27, 2024. 1 page.
GenBank: ABN53254.1 protein of unknown function DUF1557 [Acetivibrio thermocellus ATCC 27405] Aug. 25, 2017. Retrieved Mar. 27, 2024. 2 pages.
GenBank: ACC81364.1 replicative DNA helicase [Nostoc punctiforme PCC 73102] Sep. 10, 2019. Retrieved Mar. 27, 2024. 2 pages.
GenBank: ACC83218.1 DNA polymerase III, alpha subunit [Nostoc punctiforme PCC 73102] Sep. 10, 2019. Retrieved Mar. 27, 2024. 2 pages.
GenBank: ACC83986.1 nucleic acid binding, OB-fold, tRNA/helicase-type [Nostoc punctiforme PCC 73102] Sep. 10, 2019. Retrieved Mar. 27, 2024. 2 pages.
GenBank: ACX71902.1 Transcription factor TFIIB cyclin-releated protein [Methanocaldococcus vulcanius M7] Jan. 28, 2014. Retrieved Mar. 27, 2024. 2 pages.
Genbank: ADC89878.1 DNA-directed DNA polymerase [Thermocrinis albus DSM 14484] Jan. 8, 2015. Retrieved Mar. 27, 2024. 2 pages.
GenBank: ADL99605.1 Sequence 69 from U.S. Pat. No. 7,723,103. Aug. 13, 2010. Retrieved Mar. 27, 2024. 1 page.
GenBank: AMC51766.1 recombinase A [*Mycobacterium tuberculosis* variant bovis BCG] Feb. 3, 2016. Retrieved Mar. 27, 2024. 2 pages.
GenBank: BAA06142.2 DNA-dependent DNA polymerase [*Pyrococcus* sp.] Jan. 15, 2003. Retrieved Mar. 27, 2024. 2 pages.
GenBank: BAA29190.1 1434aa long hypothetical protein [Pyrococcus horikoshii OT3] May 10, 2017. Retrieved Mar. 27, 2024. 2 pages.
GenBank: BAA29695.1 1108aa long hypothetical cell division control protein [Pyrococcus horikoshii OT3] May 10, 2017. Retrieved Mar. 27, 2024. 2 pages.
GenBank: BAB00608.1 A-ATPase A-subunit [Thermoplasma acidophilum] Nov. 1, 2007. Retrieved Mar. 27, 2024. 2 pages.

(Continued)

*Primary Examiner* — Manjunath N Rao
*Assistant Examiner* — Jae W Lee
(74) *Attorney, Agent, or Firm* — Casimir Jones, S.C.; Robert A. Goetz

(57) ABSTRACT

The present invention relates to fusion proteins and methods of using the same. Specifically, invention relates to fusion proteins comprising an intein and a DNA polymerase, and methods of using the same for DNA synthesis.

6 Claims, 9 Drawing Sheets

Specification includes a Sequence Listing.

(56) References Cited

OTHER PUBLICATIONS

GenBank: CAB50345.1 MCM inteins containing helicase, minichromosome maintenance protein [Pyrococcus abyssi GE5]. Mar. 7, 2015. Retrieved Mar. 27, 2024. 2 pages.
GenBank: CAJ57164.1 cell division control protein 21, partial [Thermococcus kodakarensis KOD1] Jul. 26, 2016. Retrieved Mar. 27, 2024. 2 pages.
GenBank: CKI67314.1 Replicative DNA helicase [Mycolicibacterium smegmatis] May 9, 2015. Retrieved Mar. 27, 2024. 2 pages.
UniProt ID: A0A142CUB2 DNA polymerase. Retrieved Mar. 27, 2024. 7 pages.
UniProt ID: A0A1J0LQA5 DNA polymerase I. Retrieved Mar. 27, 2024. 7 pages.
UniProt ID: A0A218P6T6 DNA polymerase. Retrieved Mar. 27, 2024. 6 pages.
UniProt ID: AOSXL5 DNA polymerase. Retrieved Mar. 27, 2024. 7 pages.
UniProt ID: B9K7T2 DNA polymerase I. Retrieved Mar. 27, 2024. 7 pages.
UniProt ID: C5A316 DNA polymerase II large subunit. Retrieved Mar. 27, 2024. 8 pages.
UniProt ID: C6A058 DNA repair and recombination protein RadA. Retrieved Mar. 27, 2024. 6 pages.
UniProt ID: C6A4U4 DNA polymerase II large subunit. Retrieved Mar. 27, 2024. 8 pages.
UniProt ID: C7AIP4 DNA polymerase. Retrieved Mar. 27, 2024. 6 pages.
UniProt ID: D0VWU9 DNA polymerase. Retrieved Mar. 27, 2024. 5 pages.
UniProt ID: E7FHX6 Vitamin B12-dependent ribonucleoside-diphosphate reductase. Retrieved Mar. 27, 2024. 7 pages.
UniProt ID: E9KLD9 DNA polymerase. Retrieved Mar. 27, 2024. 6 pages.
UniProt ID: F0LKL3 DNA polymerase II large subunit. Retrieved Mar. 27, 2024. 8 pages.
UniProt ID: H9CW54 DNA polymerase. Retrieved Mar. 27, 2024. 7 pages.
UniProt ID: O33845 DNA polymerase. Retrieved Mar. 27, 2024. 7 pages.
UniProt ID: O34996 DNA polymerase I. Retrieved Mar. 27, 2024. 8 pages.
UniProt ID: O52225 DNA polymerase I, thermostable. Retrieved Mar. 27, 2024. 7 pages.
UniProt ID: O58001 DNA repair and recombination protein RadA. Retrieved Mar. 27, 2024. 7 pages.
UniProt ID: P00581 DNA-directed DNA polymerase. Retrieved Mar. 27, 2024. 7 pages.
UniProt ID: P00582 DNA polymerase I. Retrieved Mar. 27, 2024. 10 pages.
UniProt ID: P03680 DNA polymerase. Retrieved Mar. 27, 2024. 11 pages.
UniProt ID: P0CL76 DNA polymerase 1. Retrieved Mar. 27, 2024. 7 pages.
UniProt ID: P17255 V-type proton ATPase catalytic subuint A. Retrieved Mar. 27, 2024. 9 pages.
UniProt ID: P19821 DNA polymerase I, thermostable. Retrieved Mar. 27, 2024. 8 pages.
UniProt ID: P30313 DNA polymerase I, thermostable. Retrieved Mar. 27, 2024. 7 pages.
UniProt ID: P30317 DNA polymerase. Retrieved Mar. 27, 2024. 8 pages.
UniProt ID: P52028 DNA polymerase I, thermostable. Retrieved Mar. 27, 2024. 7 pages.
UniProt ID: P56689 DNA polymerase. Retrieved Mar. 27, 2024. 7 pages.
UniProt ID: P61875 DNA polymerase. Retrieved Mar. 27, 2024. 8 pages.
UniProt ID: P61876 DNA polymerase. Retrieved Mar. 27, 2024. 6 pages.
UniProt ID: P72065 DNA gyrase subunit A. Retrieved Mar. 27, 2024. 6 pages.
UniProt ID: P74750 DNA polymerase III subunit alpha. Retrieved Mar. 27, 2024. 10 pages.
UniProt ID: P74918 DNA polymerase. Retrieved Mar. 27, 2024. 8 pages.
UniProt ID: P80194 DNA polymerase I, thermostable. Retrieved Mar. 27, 2024. 7 pages.
UniProt ID: Q08IE4 DNA polymerase I. Retrieved Mar. 27, 2024. 7 pages.
UniProt ID: Q1WDM6 DNA polymerase. Retrieved Mar. 27, 2024. 7 pages.
UniProt ID: Q1WDM7 DNA polymerase. Retrieved Mar. 27, 2024. 7 pages.
UniProt ID: Q2Q453 DNA polymerase. Retrieved Mar. 27, 2024. 7 pages.
UniProt ID: Q45458 DNA polymerase I. Retrieved Mar. 27, 2024. 4 pages.
UniProt ID: Q51334 DNA polymerase. Retrieved Mar. 27, 2024. 9 pages.
UniProt ID: Q55418 Replicative DNA helicase. Retrieved Mar. 27, 2024. 5 pages.
UniProt ID: Q56366 DNA plymerase. Retrieved Mar. 27, 2024. 7 pages.
Uniprot ID: Q58191 Uncharacterized protein MJ0781. Retrieved Mar. 27, 2024. 4 pages.
Uniprot ID: Q58192 Transcription initiatin factor IIB. Retrieved Mar. 27, 2024. 4 pages.
UniProt ID: Q5JET0 DNA polymerase II large subunit. Retrieved Mar. 27, 2024. 9 pages.
Uniprot ID: Q72GP2 DNA polymerase III subunit alpha. Retrieved Mar. 27, 2024. 7 pages.
UniProt ID: Q97CQ0 V-type ATP syntase alpha chain. Retrieved Mar. 27, 2024. 8 pages.
UniProt ID: Q9HMX8 DNA polymerase II large subunit. Retrieved Mar. 27, 2024. 9 pages.
UniProt ID: Q9V2F4 DNA polymerase II large subunit. Retrieved Mar. 27, 2024. 9 pages.
UniProt ID: Q9X1V4 DNA polymerase I. Retrieved Mar. 27, 2024. 8 pages.
Extended EP Search Report, EP Patent Application No. 21862246.2, dated Aug. 8, 2024, 10 pages.
Apgar, James et al. "A Predictive Model of Intein Insertion Site for Use in the Engineering of Molecular Switches (e37355)", PLoS ONE, vol. 7, No. 5, May 23, 2012, pp. 1-14.
Shah, Neel H. et al. "Ultrafast Protein Splicing is Common among Cyanobacterial Split Inteins: Implications for Protein Engineering" Journal of the American Chemical Society, vol. 134, No. 28, Jul. 18, 2012, pp. 11338-11341.
Marsic, Damien et al. "New DNA polymerase from the hyperthermophilic marine archaeon Thermococcus thioreducens" Extremophiles, Life Under Extreme Conditions, vol. 12, No. 6, Aug. 1, 2008, pp. 775-788.

ENGINEERED POLYMERASES AND METHODS OF USING THE SAME

PRIORITY

This application claims priority to U.S. Provisional Application No. 63/071,493, filed Aug. 28, 2020, the entire contents of which are incorporated herein by reference.

FEDERAL FUNDING

This invention was made with Government support under Federal Grant no. 1P01-AI104533-01A1 awarded by the National Institutes of Health (NIH). The Federal Government has certain rights to this invention.

TECHNICAL FIELD

The present disclosure relates to fusion proteins and methods of using the same. Specifically, the disclosure relates to fusion proteins comprising a DNA polymerase and an intein inserted at a designated position within the DNA polymerase, and methods of using the same for DNA synthesis.

BACKGROUND

PCR (polymerase chain reaction), isothermal amplification, reverse transcription (RT), and sequencing, catalyzed by DNA polymerases, are among the most common reactions conducted in life science, medical, and clinical laboratories. They have been widely used for numerous applications such as clinical diagnoses, biological technologies, molecular cloning, gene synthesis, etc., including the current COVID-19 coronavirus test kits. According to Allied Market Research, the global market value of PCR alone was over 7 billion USD in 2016. However, both PCR and isothermal amplification technologies suffer from nonspecific products of DNA polymerases, which could lead to low yield of the target product and ambiguous results. The inconclusive test results are particularly troublesome for clinical applications, in which accurate and specific results are essential for diagnosis and decision making. In February 2020, New York Times and CNN reported about flawed COVID-19 test kits that could not produce conclusive results. In consequence, the Centers for Disease Control had to recall and replace these test kits, which potentially delayed the testing of COVID-19 in the US. Moreover, the nonspecific activity of DNA polymerases restricts the number of samples that could be handled together, especially for clinical uses. This is due to that the increasing number of samples leads to more preparation time, which could result in nonspecific product accumulation. As more COVID-19 tests are required in the pandemic, this defect could have a greater impact on the healthcare system. Thus, the current COVID-19 pandemic creates an urgent need for technologies to suppress or eliminate nonspecific activities of DNA polymerases.

Currently, the nonspecific product problem is tackled by the strategy of "hot start", which involves blocking the DNA polymerases at room temperature using external reagents such as physical blocking, chemical modifications, antibodies, aptamers, etc. According to BCC Research, among all the PCR technologies in the market, the emerging hot start PCR had expanded to 6.3% of the market share in 2015 and has the highest estimated CAGR of that time. However, these hot start technologies are restricted by defects such as incomplete inhibition, incomplete activation, reduced performance, low product yield, time consuming production, high cost, complicated handling, etc. Since the manufacture of many external reagents cannot be speedily scaled up, it is difficult to produce more hot start kits when the demand is increasing rapidly, such as during the current COVID-19 pandemic. Accordingly, there remains an urgent need for conditionally activated DNA polymerases that may be used in simple methods of DNA synthesis with high specificity.

SUMMARY

In some aspects, provided herein are fusion proteins. In some embodiments, provided herein is a fusion protein comprising a target DNA polymerase and an intein. The intein is inserted at a designated position in the target DNA polymerase. In some embodiments, insertion of the intein at the designated position in the target DNA polymerase inhibits its activity of the target DNA polymerase. For example, insertion of the intein at the designated position in the target DNA polymerase may inhibit polymerase activity and/or exonuclease activity of the target DNA polymerase. In some embodiments, the intein is inserted at a designated position in the target DNA polymerase such that binding of a substrate to an active site of the target DNA polymerase is inhibited.

The intein may be inserted in any suitable location of the target DNA polymerase in order to inhibit activity of the target DNA polymerase while facilitating activity (e.g. splicing) of the intein. In some embodiments, the intein is inserted within a flexible loop of the target DNA polymerase. In some embodiments, the flexible loop is within a thumb domain, a finger domain, a palm domain, or an exonuclease domain of the target DNA polymerase. In some embodiments, the intein is inserted between 10 to 50 Å from the active site of the target DNA polymerase.

Any suitable target DNA polymerase may be used in the fusion proteins described herein. In some embodiments, the target DNA polymerase is an A family DNA polymerase. For example, the target DNA polymerase may be selected from Taq polymerase, Tth polymerase, Tfl polymerase, Tfi polymerase, Tbr polymerase, Tca polymerase, Tma polymerase, Tne polymerase, Bst polymerase, Bsm polymerase, Bsu polymerase, *E. coli* DNA polymerase I, Bacteriophage T7 DNA polymerase, 3173 Pol, or variants thereof. In particular embodiments, the target DNA polymerase is Taq polymerase or a variant thereof. For example, the target DNA polymerase may comprise an amino acid sequence having at least 80% sequence identity with SEQ ID NO: 2. For example, the target DNA polymerase may comprise the amino acid sequence of SEQ ID NO: 3.

In some embodiments, the target DNA polymerase is a B family DNA polymerase. For example, the target DNA polymerase may be selected from the group consisting of Pfu polymerase, Pst polymerase, Pab polymerase, Pwo polymerase, KOD polymerase, Tli polymerase, Tgo polymerase, 9° N DNA Polymerase, Tfu polymerase, Tpe polymerase, Tzi polymerase, T-NA1 polymerase, T-GT polymerase, Tag polymerase, Tce polymerase, Tmar polymerase, Tpa polymerase, Tthi polymerase, Twa polymerase, phi29 DNA polymerase, and variants thereof. In particular embodiments, the target DNA polymerase is Pfu polymerase or a variant thereof. For example, the target DNA polymerase may comprise an amino acid sequence having at least 80% sequence identity with SEQ ID NO: 11. For example, the target DNA polymerase may comprise the amino acid sequence of SEQ ID NO: 12.

In some embodiments, the target DNA polymerase possesses reverse transcriptase activity. In some embodiments, the target DNA polymerase is a chimera. For example, the target DNA polymerase may be a chimera comprising at least one domain from an A family DNA polymerase and at least one domain from a different A family DNA polymerase. As another example, the target DNA polymerase may be a chimera comprising at least one domain from a B family DNA polymerase and at least one domain from a different B family DNA polymerase.

In some embodiments, the intein is inserted within a flexible loop between residues 311-320, residues 381-401, residues 546-597, or residues 782-786 of a Taq polymerase or a corresponding region in a different A family DNA polymerase. In some embodiments, the intein is inserted within a flexible loop between residues 671-686 or residues 734-737 of a Taq polymerase or a corresponding region in a different A family DNA polymerase. In some embodiments, the intein is inserted within a flexible loop between residues 452-545 of a Taq polymerase or a corresponding region in a different A family DNA polymerase.

In some embodiments, the intein is inserted within a flexible loop between residues 365-399 or residues 572-617 of a Pfu polymerase or a corresponding region in a different B family DNA polymerase. In some embodiments, the intein is inserted within a flexible loop between residues 499-508 or residues 417-448 of a Pfu polymerase or a corresponding region in a different B family DNA polymerase. In some embodiments, the intein is inserted within a flexible loop between residues 618-759 of a Pfu polymerase or a corresponding region in a different B family DNA polymerase. In some embodiments, the intein is inserted within a flexible loop between residues 145-156, residues 209-214, residues 243-248, residues 260-305, or residues 347-349 of a Pfu polymerase or a corresponding region in a different B family DNA polymerase.

For any of the fusion proteins described herein, the wild-type form of the target DNA polymerase may be found in a thermophilic organism. The target DNA polymerase may possess enzymatic activity at temperatures of greater than 50° C. The target DNA polymerase is stable at temperatures of greater than 60° C.

For the fusion proteins described herein, the intein may be a large intein, a mini-intein, or a split intein.

In some embodiments, protein splicing activity of the intein is regulated by one or more factors. In such embodiments, activation of protein splicing results in release of the target DNA polymerase from the fusion protein. In some embodiments, the released target DNA polymerase possesses increased activity compared to the activity of the target DNA polymerase when present in the fusion protein. For example, the released target DNA polymerase possesses increased DNA polymerase activity and/or increased exonuclease activity compared to the target DNA polymerase when present in the fusion portion. The one or more factors that regulate protein splicing activity of the intein may be temperature, pH, and/or divalent ions. For example, protein splicing activity of the intein may be activated by temperatures of 30° C. or greater. In some embodiments, splicing activity of the intein is activated by temperatures of 4° C. or greater. In still other embodiments, protein splicing activity of the intein is activated by temperatures of 50° C. or greater.

In some embodiments, the intein is selected from PI-PfuI intein, PI-PfuII intein, Tth-HB27 DnaE-1 intein, Neq Pol intein, Tmar Pol intein, Tfu Pol-1 intein, Tfu Pol-2 intein, Pab PolII intein, Pho PolII intein, Psp-GBD Pol intein, Pho CDC21-1 intein, Pab CDC21-1 intein, Tko CDC21-1 intein, Mja TFIIB intein, Mvu TFIIB intein, Pho RadA intein, Tsi RadA intein, Tvo VMA intein, Sce VMA intein, Ssp DnaE intein, Tsi PolII intein, Tga PolII intein, Tko PolII intein, Tba PolII intein, Mja KlbA intein, Pho CDC21-2 intein, Hsp CDC21 intein, Hsp PolII intein, Mxe GyrA intein, and variants thereof.

In some embodiments, the factor that regulates protein splicing activity of the intein is a divalent ion, wherein the presence of one or more divalent ions inhibits protein splicing activity of the intein. In some embodiments, the intein is selected from PI-PfuI intein, Neq Pol intein, Ssp DnaE intein, Msm DnaB-1 intein, Mtu RecA intein, and variants thereof.

In some embodiments, the intein is selected from PI-PfuI intein, PI-PfuII intein, Tth-HB27 DnaE-1 intein, Neq Pol intein, Tmar Pol intein, Tfu Pol-1 intein, Tfu Pol-2 intein, Pab PolII intein, Pho PolII intein, Tsi PolII intein, Tga PolII intein, Tko PolII intein, Tba PolII intein, Psp-GBD Pol intein, Pho CDC21-1 intein, Pab CDC21-1 intein, Tko CDC21-1 intein, Mja TFIIB intein, Mvu TFIIB intein, Pho RadA intein, Tsi RadA intein, Mja KlbA intein, Pho CDC21-2 intein, Hsp CDC21 intein, Hsp PolII intein, Mth RIR1 intein, Mxe GyrA intein, Tvo VMA intein, Tac VMA intein, Sce VMA intein, Ssp DnaE intein, Npu DnaE intein, Ssp DnaB intein, Npu DnaB intein, Msm DnaB-1 intein, Mtu RecA intein, gp41-1 intein, Tko Pol-2 intein, Cth BIL intein, Cne PRP8 intein, and variants thereof.

In some embodiments, the intein comprises an amino acid sequence having at least 80% sequence identity with an amino acid sequence provided in Table 1, Table 2, or Table 3. In some embodiments, wild-type form of the intein is found in a thermophilic organism. The intein may be stable at temperatures of greater than 50° C. In some embodiments, the intein comprises an amino acid sequence having at least 80% sequence identity to SEQ ID NO: 6. In some embodiments, the intein comprises the amino acid sequence of SEQ ID NO: 5. In some embodiments, the intein comprises an amino acid sequence having at least 80% sequence identity with SEQ ID NO: 4.

The fusion proteins described herein may further comprise a purification tag. The purification tag may be inserted within the intein.

In some embodiments, the fusion protein comprises an amino acid sequence having at least 80% sequence identity with SEQ ID NO: 1 or SEQ ID NO: 10.

The fusion proteins described herein may be formulated into a composition. In some embodiments, the composition further comprises a nucleic acid template. In some embodiments, the composition further comprises a reaction buffer. Such compositions may be used in methods for amplifying nucleic acid (e.g. amplifying the nucleic acid template). In some embodiments, compositions are in methods of polymerase chain reaction (PCR), reverse-transcription PCR (RT-PCR), isothermal amplification, reverse transcription, or sequencing. For example, compositions described herein may be used in one-step RT-PCR or two-step RT-PCR.

In some aspects, provided herein are methods of amplifying nucleic acid. The methods are performed using a composition comprising a fusion protein as described herein. In some embodiments, methods for amplifying nucleic acid providing a composition comprising a nucleic acid template and a fusion protein comprising a target DNA polymerase and an intein inserted at a designated position in the target DNA polymerase. Insertion of the intein at the designated position inhibits activity of the target DNA polymerase. The methods further comprise changing one or more factors to induce release of the target DNA polymerase from the fusion protein. The released target DNA polymerase possesses increased activity compared to the target DNA polymerase containing the inserted intein. The methods further comprise amplifying the nucleic acid template in the composition. In some embodiments, the protein splicing activity of the intein is regulated by the one or more factors. Modification of the one or more factors thereby induces activation of protein splicing, resulting in release of the target DNA polymerase from the fusion protein.

DETAILED DESCRIPTION

Figure 1:
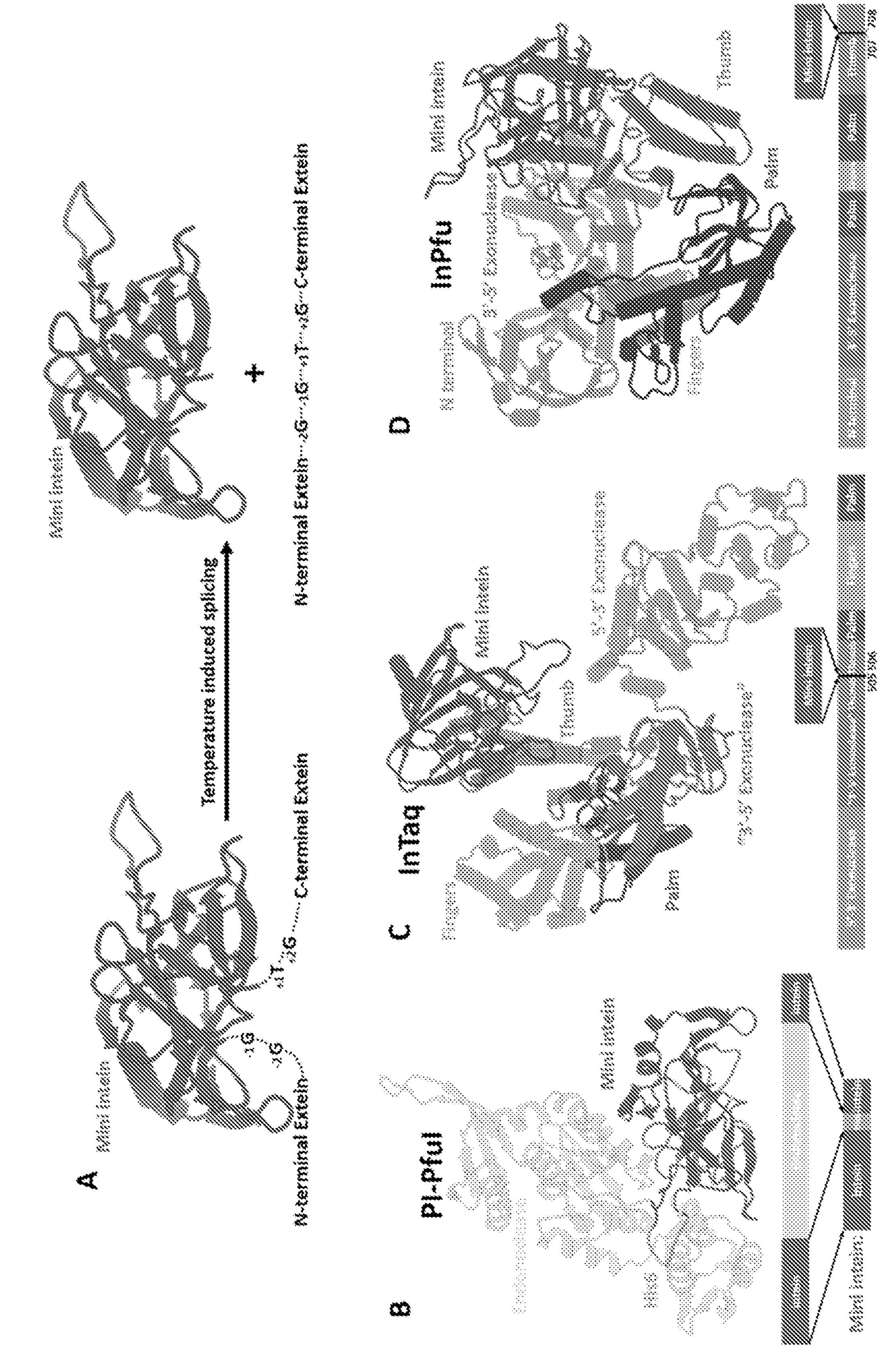
FIG. 1: Design of auto hot start DNA polymerases. A. PI-PfuI mini intein is inserted between glycine and threonine of a "GGTG" sequence that is important to support efficient splicing. At the proper temperature, the protein splicing is induced, resulting in the release of the intein and the mature extein. The model is built based on the structure of PI-PfuI intein (PDB ID: 1DQ3). B. The design of PI-PfuI mini intein. The endonuclease domain of wildtype PI-PfuI intein is replaced by a His6 purification tag, resulting in PI-PfuI mini intein. The model is built based on the structure of PI-PfuI intein (PDB ID: 1DQ3). C. The design of InTaq DNA polymerase. The intein is inserted in a loop in the thumb domain of Taq DNA polymerase. The model is built based on the structures of Taq DNA polymerase (PDB ID: 1TAQ) and PI-PfuI (PDB ID: 1DQ3). D. The design of InPfu DNA polymerase. The intein is inserted in a loop in the thumb domain of Pfu DNA polymerase. The model is built based on the structure of Pfu DNA polymerase (PDB ID: 4AIL) and PI-PfuI (PDB ID: 1DQ3).

In nature, DNA is replicated or synthesized by DNA polymerases using either DNA or RNA as a template. DNA polymerases sequentially add deoxyribonucleotides into the newly synthesized strand using deoxyribonucleoside triphosphates (dNTPs). This process is catalyzed by divalent metal ions coordinated by conserved residues at the DNA polymerase active site, which is powered from the hydrolysis of dNTPs. The DNA synthesizing functions of DNA polymerases have been developed into numerous biotechnologies such as Polymerase Chain Reaction (PCR), isothermal amplification, reverse transcription (RT), DNA sequencing, gene synthesis, clinical diagnoses, etc. However, the nonspecific products generated by DNA polymerases diminish the accuracy, specificity, and yield of these applications, which creates an urgent need for technologies to suppress nonspecific DNA polymerase activities.

An intein (intervening protein) is a protein that can, under the appropriate conditions, autocatalytically excise itself from a protein precursor through the cleavage of two peptide bonds, and concomitantly ligate the flanking protein fragments through the formation of a new peptide bond to produce a mature host protein (referred to as an extein, or external protein). This intein catalyzed process is called protein splicing. This protein splicing process requires no external energy source. Although the diverse sequences of inteins lead to different precise splicing processes, they all share similar structural folding and a similar splicing mechanism.

In a basic sense, the splicing process starts with the peptide bond cleavage between intein and −1 residue, which is the extein residue linking to the N-terminus of the intein (the residue linking to the N-terminus of −1 residue is −2 residue, and so on). A (thio)ester bond is subsequently formed between −1 residue and the side chain of +1 residue, which is the extein residue linking to the C-terminus of the intein (the residue linking to the C-terminus of +1 residue is +2 residue, and so on). The +1 residue is cysteine, serine, or threonine in all known inteins. Afterward, the peptide bond between intein and +1 residue is cleaved, leading to the releasing of the intein. Finally, the (thio)ester bond between −1 residue and the side chain of +1 residue breaks, and the peptide bond between −1 and +1 residues forms, resulting in the mature extein. During the splicing process, inteins can also generate side products such as the free N- or C-terminal exteins (the extein fragment linked to the N- or C-terminal of intein) by N- or C-terminal cleavage, respectively.

In some aspects, provided herein are fusion proteins comprising a target DNA polymerase and an intein, and methods of using the same. The intein may be inserted at a suitable position within the DNA polymerase to suppress activity of the DNA polymerase while the intein is present. The activity (e.g. splicing) of the intein may be regulated by one or more external factors, thereby producing an intein-controlled DNA polymerase that is active only when the intein is excised from the fusion protein and the DNA polymerase is freed.

For the purposes of promoting an understanding of the principles of the present disclosure, reference will now be made to preferred embodiments and specific language will be used to describe the same. It will nevertheless be understood that no limitation of the scope of the disclosure is thereby intended, such alteration and further modifications of the disclosure as illustrated herein, being contemplated as would normally occur to one skilled in the art to which the disclosure relates.

Definitions

Unless otherwise defined, all technical terms used herein have the same meaning as commonly understood by one of ordinary skill in the art to which this disclosure belongs. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

The use of the terms "a" and "an" and "the" and "at least one" and similar referents in the context of describing the invention (especially in the context of the following claims) are to be construed to cover both the singular and the plural, unless otherwise indicated herein or clearly contradicted by context.

The use of the term "at least one" followed by a list of one or more items (for example, "at least one of A and B") is to be construed to mean one item selected from the listed items (A or B) or any combination of two or more of the listed items (A and B), unless otherwise indicated herein or clearly contradicted by context.

As used herein, the term "about" is used to provide flexibility to a numerical range endpoint by providing that a given value may be "slightly above" or "slightly below" the endpoint without affecting the desired result. In some embodiments, "about" may refer to variations of in some embodiments ±20%, in some embodiments ±10%, in some embodiments ±5%, in some embodiments ±1%, in some embodiments ±0.5%, and in some embodiments ±0.1% from the specified amount.

As used herein, the terms "comprise", "include", and linguistic variations thereof denote the presence of recited feature(s), element(s), method step(s), etc. without the exclusion of the presence of additional feature(s), element(s), method step(s), etc.

Recitation of ranges of values herein are merely intended to serve as a shorthand method of referring individually to each separate value falling within the range, unless otherwise-indicated herein, and each separate value is incorporated into the specification as if it were individually recited herein. For example, if a concentration range is stated as 1% to 50%, it is intended that values such as 2% to 40%, 10% to 30%, or 1% to 3%, etc., are expressly enumerated in this specification. These are only examples of what is specifically intended, and all possible combinations of numerical values between and including the lowest value and the highest value enumerated are to be considered to be expressly stated in this disclosure.

The term "amino acid" refers to natural amino acids, unnatural amino acids, and amino acid analogs, all in their D and L stereoisomers, unless otherwise indicated, if their structures allow such stereoisomeric forms.

Natural amino acids include alanine (Ala or A), arginine (Arg or R), asparagine (Asn or N), aspartic acid (Asp or D), cysteine (Cys or C), glutamine (Gln or Q), glutamic acid (Glu or E), glycine (Gly or G), histidine (His or H), isoleucine (Ile or I), leucine (Leu or L), Lysine (Lys or K), methionine (Met or M), phenylalanine (Phe or F), proline (Pro or P), serine (Ser or S), threonine (Thr or T), tryptophan (Trp or W), tyrosine (Tyr or Y) and valine (Val or V).

Unnatural amino acids include, but are not limited to, azetidinecarboxylic acid, 2-aminoadipic acid, 3-aminoadipic acid, beta-alanine, naphthylalanine ("naph"), aminopropionic acid, 2-aminobutyric acid, 4-aminobutyric acid, 6-aminocaproic acid, 2-aminoheptanoic acid, 2-aminoisobutyric acid, 3-aminoisbutyric acid, 2-aminopimelic acid, tertiary-butylglycine ("tBuG"), 2,4-diaminoisobutyric acid, desmosine, 2,2'-diaminopimelic acid, 2,3-diaminopropionic acid, N-ethylglycine, N-ethylasparagine, homoproline ("hPro" or "homoP"), hydroxylysine, allo-hydroxylysine, 3-hydroxyproline ("3Hyp"), 4-hydroxyproline ("4Hyp"), isodesmosine, allo-isoleucine, N-methylalanine ("MeAla" or "Nime"), N-alkylglycine ("NAG") including N-methylglycine, N-methylisoleucine, N-alkylpentylglycine ("NAPG") including N-methylpentylglycine. N-methylvaline, naphthylalanine, norvaline ("Norval"), norleucine ("Norleu"), octylglycine ("OctG"), ornithine ("Orn"), pentylglycine ("pG" or "PGly"), pipecolic acid, thioproline ("ThioP" or "tPro"), homoLysine ("hLys"), and homoArginine ("hArg").

The term "amino acid analog" refers to a natural or unnatural amino acid where one or more of the C-terminal carboxyl group, the N-terminal amino group and side-chain bioactive group has been chemically blocked, reversibly or irreversibly, or otherwise modified to another bioactive group. For example, aspartic acid-(beta-methyl ester) is an amino acid analog of aspartic acid; N-ethylglycine is an amino acid analog of glycine; or alanine carboxamide is an amino acid analog of alanine. Other amino acid analogs include methionine sulfoxide, methionine sulfone, S-(carboxymethyl)-cysteine, S-(carboxymethyl)-cysteine sulfoxide and S-(carboxymethyl)-cysteine sulfone.

As used herein, a "conservative" amino acid substitution refers to the substitution of an amino acid in a peptide or polypeptide with another amino acid having similar chemical properties, such as size or charge. For purposes of the present disclosure, each of the following eight groups contains amino acids that are conservative substitutions for one another:

1) Alanine (A) and Glycine (G);
2) Aspartic acid (D) and Glutamic acid (E);
3) Asparagine (N) and Glutamine (Q);
4) Arginine (R) and Lysine (K);
5) Isoleucine (I), Leucine (L), Methionine (M), and Valine (V);
6) Phenylalanine (F), Tyrosine (Y), and Tryptophan (W);
7) Serine (S) and Threonine (T); and
8) Cysteine (C) and Methionine (M).

Naturally occurring residues may be divided into classes based on common side chain properties, for example: polar positive (or basic) (histidine (H), lysine (K), and arginine (R)); polar negative (or acidic) (aspartic acid (D), glutamic acid (E)); polar neutral (serine (S), threonine (T), asparagine (N), glutamine (Q)); non-polar aliphatic (alanine (A), valine (V), leucine (L), isoleucine (I), methionine (M)); non-polar aromatic (phenylalanine (F), tyrosine (Y), tryptophan (W)); proline and glycine; and cysteine. As used herein, a "semi-conservative" amino acid substitution refers to the substitution of an amino acid in a peptide or polypeptide with another amino acid within the same class.

In some embodiments, unless otherwise specified, a conservative or semi-conservative amino acid substitution may also encompass non-naturally occurring amino acid residues that have similar chemical properties to the natural residue. These non-natural residues are typically incorporated by chemical peptide synthesis rather than by synthesis in biological systems. These include, but are not limited to, peptidomimetics and other reversed or inverted forms of amino acid moieties. Embodiments herein may, in some embodiments, be limited to natural amino acids, non-natural amino acids, and/or amino acid analogs.

Non-conservative substitutions may involve the exchange of a member of one class for a member from another class.

The term "consensus sequence" as used herein refers to the −3, −2, −1, +1, +2, and +3 extein residues. The desired consensus sequence may exist naturally or may be engineered (e.g. by one or more mutations in the DNA polymerase). These residues support the function of the intein (e.g. support intein splicing).

The term "intein" as used herein refers to a protein that can autocatalytically excise itself from a protein precursor and concomitantly ligate the flanking protein fragments to produce a mature protein. The term "extein" as used herein refers to the mature protein produced as a result of such a process. The autocatalytic excision process performed by the intein to produce the mature protein is referred to herein as "splicing" or "protein splicing".

"Identical" or "identity," as used herein in the context of two or more polypeptide, amino acid, or polynucleotide sequences, can mean that the sequences have a specified percentage of residues that are the same over a specified region. The percentage can be calculated by optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces one or more staggered ends and the specified region of comparison includes only a single sequence, the residues of the single sequence are included in the denominator but not the numerator of the calculation.

"Variant" is used herein to describe a protein (e.g. a polymerase, an intein) that differs from a reference protein in amino acid sequence by the insertion, deletion, or substitution of amino acids, but retains at least one biological activity of the reference protein. Representative examples of "biological activity" include the ability to perform a typical enzymatic function associated with that protein (e.g. for polymerases, to retain polymerase and/or exonuclease activity and for inteins, to retain protein splicing ability). For example, a variant of a polymerase may differ in amino acid sequence from the wild-type polymerase, but still retains at least one biological activity (e.g. functional polymerase activity, functional exonuclease activity) compared to the wild-type. As another example, a variant of an intein may differ in amino acid sequence from the wild-type intein, but still retain at least one biological activity (e.g. functional protein splicing) compared to the wild-type. A "variant" may also be referred to as a "mutant" or an "engineered" version herein.

In one aspect, provided herein are engineered fusion proteins comprising a target DNA polymerase and an intein. Any suitable target DNA polymerase may be used in the fusion proteins described herein. Currently, DNA polymerases are classified into A, B, C, D, X, Y, and RT (reverse transcriptase) families according to sequence similarity. A, B, C, D, X, and Y family DNA polymerases mainly utilize DNA as the template for DNA synthesis, while RT family DNA polymerases mainly utilize RNA as the template for DNA synthesis (reverse transcription). All DNA polymerases synthesize DNA by transferring deoxyribonucleotides from dNTPs onto the 3'-OH group of the newly synthesized strand, catalyzing the 5' to 3' polymerase activity. The fusion protein may comprise an A family, B family, C family, D family, X family, Y family, or RT family DNA polymerase.

Despite the sequence diversity among polymerase families, activity centers of all DNA polymerases contain palm, thumb, and finger domains. Conserved residues in the palm domain coordinate divalent metal ions to catalyze the polymerase reaction. The finger domain mainly binds the incoming dNTP. The thumb domain is critical for the proper interaction between the DNA duplex and the DNA polymerase. In addition to the polymerase activity, many DNA polymerases have other activities, such as nuclease activity and strand displacement activity, which are generally catalyzed by additional regions or domains. In some embodiments, the DNA polymerase comprises a palm domain, a thumb domain, and a finger domain. In some embodiments, the DNA polymerase comprises a palm domain, a thumb domain, a finger domain, and an exonuclease domain.

In some embodiments, the wild-type form of the target DNA polymerase is found in a thermophilic organism. The target DNA polymerase may possess enzymatic activity at temperatures usually employed for isothermal amplification, reverse transcription, polymerase chain reaction, etc. In some embodiments, the target DNA polymerase demonstrates enzymatic (e.g. polymerase) activity at temperatures of greater than 50° C., so long as the DNA polymerase is not bound to the intein. The temperature of 50° C. is not a lower limit, the target DNA polymerase may also possess enzymatic activity at temperatures of lower than 50° C. For example, the DNA polymerase may possess enzymatic activity at temperatures of 20° C., 30° C., 40° C., 50° C., and higher than 50° C. In some embodiments, the target DNA polymerase is stable at temperatures of greater than 60° C.

In some embodiments, target DNA polymerase is an A family DNA polymerase. Suitable A family DNA polymerases, including for example, Taq (UniProt ID: P19821, *Thermus aquaticus* DNA polymerase I), Tth (UniProt ID: P52028, *Thermus thermophilus* HB8 DNA polymerase I), Tfl (UniProt ID: P30313, the DNA polymerase isolated from *Thermus flavus*), Tfi (UniProt ID: O52225, *Thermus filiformis* DNA polymerase I), Tbr (UniProt ID: A0A1J0LQA5, *Thermus brockianus* DNA polymerase I, commercial name: DyNAzyme), Tca (UniProt ID: P80194, *Thermus caldophilus* DNA polymerase I), Tma (UniProt ID: Q9X1V4, *Thermotoga maritima* DNA polymerase I, commercial name: UITma DNA polymerase), Tne (UniProt ID: B9K7T2, *Thermotoga neapolitana* DNA polymerase I), Bst (UniProt ID: Q45458, *Geobacillus stearothermophilus* (previously *Bacillus stearothermophilus*) DNA polymerase I), Bsm (UniProt ID: Q08IE4, *Bacillus smithii* DNA polymerase I), Bsu (UniProt ID: O34996, *Bacillus subtilis* DNA polymerase I), *Escherichia coli* DNA polymerase I (UniProt ID: P00582), Bacteriophage T7 DNA polymerase (UniProt ID: P00581), 3173 Pol (GenBank: ADL99605.1, a viral DNA polymerase homologous to *Thermocrinis albus* Pol I (Genbank: ADC89878.1) and commercialized by Lucigen with names OmniAmp polymerase or PyroPhage 3173 DNA polymerase), and variants of any of the above. For example, variants of any of the above may comprise suitable amino acid mutations (e.g. substitutions, insertions, deletions, etc.) to improve one or more characteristics of the polymerase. For example, variants of the above may be employed to improve reaction fidelity, enhance DNA binding affinity, enhance thermal stability, or other desired characteristics of the DNA polymerase.

In some embodiments, the target DNA polymerase comprises an amino acid sequence having 80% or more sequence identity with an A family target DNA polymerase, such as an A family target DNA polymerase listed above. For example, the target DNA polymerase may comprise an amino acid sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity with an A family target DNA polymerase.

In some embodiments, the target DNA polymerase is Taq or a variant thereof. The amino acid sequence of wild-type Taq is:

```
                                           (SEQ ID NO: 2)
MRGMLPLFEPKGRVLLVDGHHLAYRTFHALKGLTTSRGEPVQAVYGFAK

SLLKALKEDGDAVIVVFDAKAPSFRHEAYGGYKAGRAPTPEDFPRQLAL

IKELVDLLGLARLEVPGYEADDVLASLAKKAEKEGYEVRILTADKDLYQ

LLSDRIHVLHPEGYLITPAWLWEKYGLRPDQWADYRALTGDESDNLPGV

KGIGEKTARKLLEEWGSLEALLKNLDRLKPAIREKILAHMDDLKLSWDL

AKVRTDLPLEVDFAKRREPDRERLRAFLERLEFGSLLHEFGLLESPKAL

EEAPWPPPEGAFVGFVLSRKEPMWADLLALAAARGGRVHRAPEPYKALR

DLKEARGLLAKDLSVLALREGLGLPPGDDPMLLAYLLDPSNTTPEGVAR

RYGGEWTEEAGERAALSERLFANLWGRLEGEERLLWLYREVERPLSAVL

AHMEATGVRLDVAYLRALSLEVAEEIARLEAEVFRLAGHPFNLNSRDQL

ERVLFDELGLPAIGKTEKTGKRSTSAAVLEALREAHPIVEKILQYRELT

KLKSTYIDPLPDLIHPRTGRLHTRFNQTATATGRLSSSDPNLQNIPVRT

PLGQRIRRAFIAEEGWLLVALDYSQIELRVLAHLSGDENLIRVFQEGRD

IHTETASWMFGVPREAVDPLMRRAAKTINFGVLYGMSAHRLSQELAIPY

EEAQAFIERYFQSFPKVRAWIEKTLEEGRRRGYVETLFGRRRYVPDLEA

RVKSVREAAERMAFNMPVQGTAADLMKLAMVKLFPRLEEMGARMLLQVH

DELVLEAPKERAEAVARLAKEVMEGVYPLAVPLEVEVGIGEDWLSAKE
```

In some embodiments, the target DNA polymerase comprises an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%) with SEQ ID NO: 2.

In some embodiments, the target DNA polymerase is a B family DNA polymerase. Unlike Taq, the B family DNA polymerases, such as the commonly used Pfu polymerase, contain a functional 3'-5' exonuclease domain for proofreading to remove misincorporated nucleotides. Thus, they have a lower error rate and are often used as high-fidelity DNA polymerases.

Suitable B family DNA polymerases include, for example, Pfu (UniProt ID: P61875, *Pyrococcus furiosus* DNA polymerase), Pst (UniProt ID: Q51334, *Pyrococcus* sp. (strain GB-D) DNA polymerase, commercialized with the name Deep Vent DNA polymerase), Pab (UniProt ID: P0CL76, *Pyrococcus abyssi* DNA polymerase, commercial name: Isis DNA polymerase), Pwo (UniProt ID: P61876, *Pyrococcus woesei* DNA polymerase), KOD (UniProt ID: D0VWU9, *Thermococcus kodakarensis* (previously *Pyrococcus kodakaraensis*)), Tli (UniProt ID: P30317, *Thermococcus litoralis* DNA polymerase, commercial name: Vent DNA polymerase), Tgo (UniProt ID: P56689, *Thermococ-*

*cus gorgonarius* DNA polymerase), 9° N DNA Polymerase (UniProt ID: Q56366, *Thermococcus* sp. (strain 9oN-7) DNA polymerase), Tfu (UniProt ID: P74918, *Thermococcus fumicolans* DNA polymerase), Tpe (UniProt ID: A0A142CUB2, *Thermococcus peptonophilus* DNA polymerase), Tzi (UniProt ID: Q1WDM7, *Thermococcus zilligii* DNA polymerase, commercialized as a fusion version with name Pfx50 DNA polymerase), T-NA1 (UniProt ID: Q2Q453, *Thermococcus onnurineus* DNA polymerase), T-GT (UniProt ID: Q1WDM6, *Thermococcus* sp. GT DNA polymerase), Tag (UniProt ID: 033845, *Thermococcus aggregans* DNA polymerase), Tce (UniProt ID: E9KLD9, *Thermococcus celer* DNA polymerase), Tmar (UniProt ID: C7AIP4, *Thermococcus marinus* DNA polymerase), Tpa (UniProt ID: A0A218P6T6, *Thermococcus pacificus* DNA polymerase), Tthi (UniProt ID: A0SXL5, *Thermococcus thioreducens* DNA polymerase), Twa (UniProt ID: H9CW54, *Thermococcus waiotapuensis* DNA polymerase), and phi29 DNA polymerase (UniProt ID: P03680, Bacteriophage phi-29 DNA polymerase), and variants of any of the above.

In some embodiments, the target DNA polymerase comprises an amino acid sequence having 80% or more sequence identity with a B family target DNA polymerase, such as a B family target DNA polymerase listed above. For example, the target DNA polymerase may comprise an amino acid sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity with a B family target DNA polymerase.

In some embodiments, the target DNA polymerase is Pfu or a variant thereof. The amino acid sequence of wild-type Pfu is:

(SEQ ID NO: 11)

```
MILDVDYITEEGKPVIRLFKKENGKFKIEHDRTFRPYIYALLRDDSKIE
EVKKITGERHGKIVRIVDVEKVEKKFLGKPITVWKLYLEHPQDVPTIRE
KVREHPAVVDIFEYDIPFAKRYLIDKGLIPMEGEEELKILAFDIETLYH
EGEEFGKGPIIMISYADENEAKVITWKNIDLPYVEVVSSEREMIKRFLR
IIREKDPDIIVTYNGDSFDFPYLAKRAEKLGIKLTIGRDGSEPKMQRIG
DMTAVEVKGRIHFDLYHVITRTINLPTYTLEAVYEAIFGKPKEKVYADE
IAKAWESGENLERVAKYSMEDAKATYELGKEFLPMEIQLSRLVGQPLWD
VSRSSTGNLVEWFLLRKAYERNEVAPNKPSEEEYQRRLRESYTGGFVKE
PEKGLWENIVYLDFRALYPSIIITHNVSPDTLNLEGCKNYDIAPQVGHK
FCKDIPGFIPSLLGHLLEERQKIKTKMKETQDPIEKILLDYRQKAIKLL
ANSFYGYYGYAKARWYCKECAESVTAWGRKYIELVWKELEEKFGFKVLY
IDTDGLYATIPGGESEEIKKKALEFVKYINSKLPGLLELEYEGFYKRGF
FVTKKRYAVIDEEGKVITRGLEIVRRDWSEIAKETQARVLETILKHGDV
EEAVRIVKEVIQKLANYEIPPEKLAIYEQITRPLHEYKAIGPHVAVAKK
LAAKGVKIKPGMVIGYIVLRGDGPISNRAILAEEYDPKKHKYDAEYYIE
NQVLPAVLRILEGFGYRKEDLRYQKTRQVGLTSWLNIKKS
```

In some embodiments, the target DNA polymerase comprises an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%) with SEQ ID NO: 11.

In some embodiments, the target DNA polymerase comprises one or more mutations. For example, one or more residues may be mutated to a glycine to support intein splicing. Selection of which particular residues may be mutated to glycine may depend on the designated position for intein insertion. For example, one or residues proximal to (e.g. within 5 amino acids) the intein insertion site (e.g. proximal to the N-terminal amino acid of the inserted intein and/or proximal to the C-terminal amino acid of the inserted intein) may be mutated to a glycine. For example, to support intein splicing it may be desirable that the −5, −4, −3, −2, −1, +1, +2, +3, +4, and/or +5 residue is a glycine and suitable mutations may be made in order to accomplish this.

In some embodiments, the amino acid immediately proximal to the N-terminal amino acid of the inserted intein (e.g. the −1 residue) may be a glycine. This may occur naturally (e.g. the intein insertion site may be selected such that the −1 residue is a glycine) or the residue may be mutated to a glycine. In some embodiments, the −1 residue and the −2 residue may be a glycine (e.g. naturally or by mutation). In some embodiments, the −1 residue, the −2 residue, and the −3 residue may be a glycine (e.g. naturally or by mutation). In some embodiments, the +2 and/or +3 residue is mutated to be a glycine to support intein splicing.

In some embodiments, the +1 residue (e.g. the residue immediately proximal to the C-terminal amino acid of the intein) is a cysteine, a serine, or threonine. This may occur naturally. For example, the intein insertion site may be selected such that the +1 residue is known to be a cysteine, a serine, or a threonine. In other embodiments, the +1 residue may be mutated to be a cysteine, a serine, or a threonine. In some embodiments, an intein naturally containing a +1 residue that is already a cysteine, a serine, or a threonine may be mutated that the +1 residue is changed from the existing cysteine, serine, or threonine to a different option of these three amino acids. For example, a +1 cysteine could be changed to a +1 serine or a +1 threonine. As another example, a +1 serine could be changed to a +1 cysteine or a +1 threonine.

In some embodiments, the target DNA polymerase comprises an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%) with SEQ ID NO: 3. In some embodiments, the target DNA polymerase comprises the amino acid sequence of SEQ ID NO: 3.

In some embodiments, the target DNA polymerase comprises an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%) with SEQ ID NO: 12. In some embodiments, the target DNA polymerase comprises the amino acid sequence of SEQ ID NO: 12.

In some embodiments, the target DNA polymerase is possesses reverse transcriptase activity. For example, the target DNA polymerase may be an RT family DNA polymerase, or may be a polymerase from a different family (e.g. an A family polymerase) that can use RNA as a template. The most widely used reverse transcriptases are AMV (Avian Myeloblastosis Virus Reverse Transcriptase) and M-MLV (Moloney Murine Leukemia Virus Reverse Transcriptase). Some A family DNA polymerases can use RNA as the template, therefore they have been developed for reverse transcription, including Taq polymerase, Tth polymerase, Tfl polymerase, 3173 Pol, Bst polymerase, Bsm polymerase, Bsu polymease and *Escherichia coli* DNA polymerase I. In some embodiments, the DNA polymerase may be modified (e.g. by one or more mutations) such that it possesses reverse transcriptase activity or to improve innate reverse transcriptase ability. For example, KOD polymerase variants processing reverse transcriptase activity may be used. As another example, Taq may be modified to improve its reverse transcription activity.

In some embodiments, the target DNA polymerase is a chimera. The chimera may comprise at least one domain from one DNA polymerase, and at least one domain from a different DNA polymerase. In some embodiments, the chimera comprises at least one domain from an A family DNA polymerase. In some embodiments, the chimera comprises at least one domain from an A family DNA polymerase and at least one domain from a different A family DNA polymerase. Suitable A family DNA polymerases are described above, including Taq polymerase, Tth polymerase, Tfl polymerase, Tfi polymerase, Tbr polymerase, Tca polymerase, Tma polymerase, Tne polymerase, Bst polymerase, Bsm polymerase, Bsu polymerase, *Escherichia coli* DNA polymerase I, Bacteriophage T7 DNA polymerase, 3173 Pol, and variants thereof.

In some embodiments, the chimera comprises at least one domain from a B family DNA polymerase. In some embodiments, the chimera comprises at least one domain from a B family DNA polymerase and at least one domain from a different B family DNA polymerase. Suitable B family DNA polymerases are described above, including Pfu polymerase, Pst polymerase, Pab polymerase, Pwo polymerase, KOD polymerase, Tli polymerase, Tgo polymerase, 9° N DNA polymerase, Tfu polymerase, Tpe polymerase, Tzi polymerase, T-NA1 polymerase, T-GT polymerase, Tag polymerase, Tce polymerase, Tmar polymerase, Tpa polymerase, Tthi polymerase, Twa polymerase, phi29 polymerase, and variants thereof.

The fusion protein further comprises an intein inserted at a designated position in the target DNA polymerase. In some embodiments, insertion of the intein at the designated position inhibits activity of the target DNA polymerase. For example, insertion of the intein at the designated position in the target DNA polymerase may inhibit polymerase activity of the target DNA polymerase. As another example, insertion of the intein at the designated position in the target DNA polymerase may inhibit exonuclease activity of the target DNA polymerase. In some embodiments, insertion of the intein at the designated position in the target DNA polymerase may inhibit polymerase and exonuclease activity of the target DNA polymerase.

In some embodiments, the intein may be inserted at a designated position in the target DNA polymerase such that binding of a substrate (e.g. DNA) to the active site of the target DNA polymerase is inhibited. For example, the intein may be inserted at a suitable position within the target DNA polymerase to 1) physically block the DNA polymerase active site; and/or 2) compromise the DNA binding ability of the DNA polymerase; and/or 3) disrupt the function of DNA polymerase allosterically.

The intein may be inserted in any suitable location within the target DNA polymerase to. In general, a suitable insertion location within the target DNA polymerase should inhibit activity (e.g. polymerase activity, exonuclease activity, reverse transcriptase activity) of the target DNA polymerase activity when the intein is fused, support the intein protein splicing reaction, and result in a functional DNA polymerase after the intein is spliced.

To support the intein protein splicing reaction, the insert position should not affect the structure and function of the inserted intein. Moreover, the insert position should be able to provide the extein −3 to −1 and +1 to +3 residues (also referred to herein as the "consensus sequence") that support intein splicing. If the extein −3 to −1 and +1 to +3 residues do not naturally exist in the DNA polymerase, such sequences may be inserted artificially into the DNA polymerase.

To result in a functional DNA polymerase after the intein is spliced, the insertion position should enable the release of the intein from the DNA polymerase. Moreover, the extein −3 to −1 and +1 to +3 residues remaining after protein splicing should have limited or no effect on the activity or function of the released DNA polymerase. Similarly, if the extein −3 to −1 and +1 to +3 residues are mutated to support protein splicing, the extein mutations should have limited or no effect on the activity or function of the released DNA polymerase.

In some embodiments, a short linker sequence or multiple short linker sequences may be added to enable the proper insertion of the intein. Such short linker(s) also should have limited or no effect on the activity or function of the DNA polymerase.

In some embodiments, the intein is inserted within a flexible loop of the target DNA polymerase. Since such loops are structurally flexible, they demonstrate more plasticity to support the intein for the protein splicing reaction. In addition, the flexibility of loops also decreases interference from other parts of the DNA polymerase. In some embodiments, the flexible loop is within the thumb domain, a finger domain, the palm domain, or the exonuclease domain of the target DNA polymerase. In particular embodiments, the intein may be inserted within a flexible loop proximal to the active site. In some embodiments, the intein may be inserted such that the intein is between 10 to 50 Å of the active site of the target DNA polymerase. For example, the insertion position may be about 10 Å, about 15 Å, about 20 Å, about 25 Å, about 30 Å, about 35 Å, about 40 Å, about 45 Å, or about 50 Å from the active site.

In some embodiments, the target DNA polymerase is an A family DNA polymerase or a chimera comprising at least one domain from an A family DNA polymerase. In some embodiments, the target DNA polymerase is Taq polymerase or a variant thereof. In some embodiments, the intein is inserted within a flexible loop between residues 311-320, residues 381-401, residues 546-597, or residues 782-786 of the Taq polymerase. These residues are found within the palm domain. In other embodiments, the intein is inserted within a flexible loop between residues 671-686 or residues 734-737 of the Taq polymerase. These residues are found within a finger domain. In still other embodiments, the intein is inserted within a flexible loop between residues 452-545 of the Taq polymerase. These residues are found within the thumb domain.

Although these residue numbers are specific for Taq polymerase, these residues may be used to determine the corresponding residues for suitable intein insertion locations in other A family DNA polymerases. Accordingly, the intein may be inserted at a flexible loop within the above-described residues of Taq polymerase or in a corresponding flexible loop of a different A family DNA polymerase. Sequence alignment may be used to determine appropriate corresponding locations. For example, the sequences of two DNA polymerases (e.g. Taq polymerase and another A family DNA polymerase) may be aligned, and the residues corresponding to the above-listed residues for Taq polymerase may be identified. In some embodiments, software may be used to perform the alignment and to identify residues predicted to have secondary structures vs. residues that are likely to be flexible loops. For sequences that do not completely align, residues ranges may be adjusted accordingly. For example, residues may be adjusted to account for extra residues, missing residues, etc. in one polymerase compared to the other. As one example, sequence alignment may be performed to determine that residues 782-786 of Taq polymerase correspond to residues 784-788 of Tth polymerase.

In some embodiments, flexible loops are considered the same loop topologically, although they may have different lengths and residue numbers. When protein sequences are aligned, the two flexible loops may not exemplify high level of alignment, but the regions surrounding the flexible loop are well aligned, thus confirming that the two flexible loops (e.g. the flexible loop in Taq polymerase and the flexible loop in another A family DNA polymerase) do indeed correspond to each other. In such embodiments, flexible loops identified as corresponding to any of the above-described flexible loops in Taq polymerase may be used as intein insertion sites in other A family DNA polymerases.

In some embodiments, the target DNA polymerase is a B family DNA polymerase or a chimera comprising at least one domain from a B family DNA polymerase. In some embodiments, the target DNA polymerase is Pfu polymerase or a variant thereof. In some embodiments, the intein may be inserted within a flexible loop between residues 365-399 or residues 572-617 of the Pfu polymerase. These residues are within the palm domain. In other embodiments, the intein is inserted within a flexible loop between residues 499-508 or residues 417-448 of the Pfu polymerase. These residues are found within a finger domain. In other embodiments, the intein is inserted within a flexible loop between residues 618-759 of Pfu polymerase. These residues are within the thumb domain. In still other embodiments, the intein is inserted within a flexible loop between residues 145-156, residues 209-214, residues 243-248, residues 260-305, or residues 347-349 of Pfu polymerase. These residues are within the exonuclease domain.

Although these residue numbers are specific for Pfu polymerase, these residues may be used to determine the corresponding residues for suitable intein insertion locations in other B family DNA polymerases. Sequence alignment may be used to determine appropriate corresponding locations. For example, the sequences of two DNA polymerases (e.g. Pfu polymerase and another B family DNA polymerase) may be aligned, and the residues corresponding to the above-listed residues for Pfu polymerase may be identified. In some embodiments, software may be used to perform the alignment and to identify residues predicted to have secondary structures vs. residues that are likely to be flexible loops. For sequences that do not completely align, residues ranges may be adjusted accordingly. For example, residues may be adjusted to account for extra residues, missing residues, etc. in one polymerase compared to the other.

In some embodiments, flexible loops are considered the same loop topologically, although they may have different lengths and residue numbers. When protein sequences are aligned, the two flexible loops may not exemplify high level of alignment, but the regions surrounding the flexible loop are well aligned, thus confirming that the two flexible loops (e.g. the flexible loop in Pfu polymerase and the flexible loop in another B family DNA polymerase) do indeed correspond to each other. In such embodiments, flexible loops identified as corresponding to any of the above-described flexible loops in Pfu polymerase may be used as intein insertion sites in other B family DNA polymerases.

Any suitable intein may be used in the fusion proteins described herein. The intein may be a large intein, a mini-intein, or a split intein. Large inteins consist of an intein domain and an endonuclease domain. The endonuclease domain is inserted within the intein domain, separating the intein domain into two parts. Mini inteins contain only the intein domain (e.g. no endonuclease domain). Split inteins are inteins that are split into two fragments, and are able to conduct splicing only when the two fragments are properly folded together.

In some embodiments, the splicing activity of the intein is regulated by one or more factors. These external factors include physical factors such as light and temperature, and chemical factors such as pH, salt, ligand binding, etc. Activation of protein splicing results in release of the target DNA polymerase from the fusion protein. The released target DNA polymerase possesses increased activity (e.g. increased DNA polymerase activity and/or increased exonuclease activity) compared to the activity of the target DNA polymerase when present in the fusion protein.

In some embodiments, the one or more factors are selected from temperature, pH, and divalent ions. For example, the factor may be temperature. In such embodiments, the intein selected is referred to as a "temperature-sensitive" intein. For example, the splicing activity of a temperature-sensitive intein may be activated by temperatures of 30° C. or greater. As another example, the splicing activity of a temperature-sensitive intein may be activated by temperatures of 40° C. or greater. As another example, the splicing activity of a temperature-sensitive intein may be activated by temperatures of 50° C. or greater. For example, intein splicing may be activated by temperatures of at least 30° C., at least 35° C., at least 40° C., at least 45° C., at least 50° C., at least 55° C., at least 60° C., at least 65° C., or greater than 70° C.

Suitable temperature-sensitive inteins that may be used in the disclosed fusion proteins include, for example, PI-PfuI intein (*Pyrococcus furiosus*, UniProt ID: E7FHX6 (residue C302-N755)), PI-PfuII intein (*Pyrococcus furiosus*, UniProt ID: E7FHX6 (residue C915-N1296)), Tth-HB27 DnaE-1 intein (*Thermus thermophiles*, Uniprot ID: Q72GP2 (residue C768-N1190)), Tmar Pol intein (*Thermococcus marinus*, UniProt ID: C7AIP4 (residue 5492-N1028)), Tfu Pol-1 intein (*Thermococcus fumicolans*, UniProt ID: P74918 (residue C407-N777)), Tfu Pol-2 intein (*Thermococcus fumicolans*, UniProt ID: P74918 (residue 5901-N1289)), Psp-GBD Pol intein (*Pyrococcus* sp. (strain GB-D), UniProt ID: Q51334 (residue 5493-N1029)), Mja TFIIB intein (*Methanocaldococcus jannaschii*, Uniprot ID: Q58192 (residue S100-N434)), Mvu TFIIB intein (*Methanocaldococcus vulcanius*, GenBank: ACX71902.1 (residue S93-N427)) and Sce VMA intein (alternative name: PI-SceI intein, *Saccha-*

*romyces cerevisiae*, UniProt ID: P17255 (residue C284-N737), PDB ID: 1DFA). Each of the above are large inteins. Each of the above may be used to create a corresponding mini intein by removing the endonuclease domain. Mini inteins derived from any of the above listed large inteins may be used in the fusion proteins described herein.

Additional suitable temperature-sensitive inteins include, for example, Pab PolII intein (*Pyrococcus abyssi*, UniProt ID: Q9V2F4 (residue C955-Q1139)) and Pho PolII intein (*Pyrococcus horikoshii*, GenBank ID: BAA29190.1 (residue C955-Q1120)). These are mini inteins. Other homologous inteins are potentially temperature sensitive, such as Tsi PolII intein (*Thermococcus sibiricus*, UniProt ID: C6A4U4 (residue C949-Q1114)), Tga PolII intein (*Thermococcus gammatolerans*, UniProt ID: C5A316 (residue C962-Q1125)), Tko PolII intein (*Thermococcus kodakarensis*, UniProt ID: Q5JET0 (residue C964-Q1437)), and Tba PolII intein (*Thermococcus barophilus*, UniProt ID: F0LKL3 (residue C952-N1426)).

Additional suitable temperature-sensitive inteins include, for example, Pho CDC21-1 intein (*Pyrococcus horikoshii*, GenBank ID: BAA29695.1 (residue C335-N502)), Pab CDC21-1 intein (*Pyrococcus abyssi*, GenBank ID CAB50345.1 (residue C335-N498)), and Tko CDC21-1 intein (*Thermococcus kodakaraensis*, GenBank: CAJ57164.1 (residue C1-N140)), Pho RadA intein (*Pyrococcus horikoshii*, UniProt ID: 058001 (residue C153-N324)), Tsi RadA intein (*Thermococcus sibiricus*, UniProt ID: C6A058 (residue C154-N321)) and Tvo VMA intein (*Thermoplasma volcanium* GSS1, UniProt ID: Q97CQ0 (residue C236-N421), PDB ID: 4O1S). These are mini inteins.

In some embodiments, a temperature-sensitive intein is a split intein. Suitable split inteins include Neq Pol intein (*Nanoarchaeum equitans*, GenBank: AAR38923.1 (5579-N676) and GenBank: AAR39369.1 (residue M1-N30)) and Ssp DnaE intein (*Synechocystis* sp. strain PCC6803, UniProt ID: P74750 (residue C775-K897 and M898-N933), PDB ID: 1ZD7).

Other suitable inteins which may be temperature-sensitive include Mja KlbA intein (*Methanocaldococcus jannaschii*, Uniprot ID: Q58191 (residue A405-N572)), Pho CDC21-2 intein (*Pyrococcus horikoshii*, GenBank ID: BAA29695.1 (residue C530-N789)), Hsp CDC21 intein (*Halobacterium* sp. NRC-1, GenBank ID: AAG20316.1 (residue C283-N464)), Hsp PolII intein (*Halobacterium* sp. NRC-1, UniProt ID: Q9HMX8 (residue C926-Q1120)) and Mxe GyrA intein (*Mycobacterium xenopi*, UniProt ID: P72065 (residue C66-N263), PDB ID: 1AM2).

Sce VMA intein (alternative name: PI-SceI intein, *Saccharomyces cerevisiae*, UniProt ID: P17255 (residue C284-N737), PDB ID: 1DFA) has been engineered to be active in the desired temperature range (Zeidler et al., 2004) and may also be used in the fusion proteins described herein.

In some embodiments, the factor is divalent ions (e.g. divalent metal ions). For example, the presence of one or more divalent ions may suppress intein activity. Addition of a suitable agent to remove or otherwise negate the divalent ions may thus disinhibit the intein, allowing for splicing to occur. For example, a chelating agent may be added to bind the metal ion, thus activating the splicing ability of the intein. In some embodiments, the intein is sensitive to the divalent metal ion $Zn^{2+}$. In some embodiments, the intein is sensitive to an alternative or additional divalent metal ion (e.g. another metal ion in addition to $Zn^{2+}$).

Suitable $Zn^{2+}$ sensitive inteins include, for example, the large intein PI-PfuI intein (*Pyrococcus furiosus*, UniProt ID: E7FHX6 (residue C302-N755), PDB ID: 1DQ3), the large intein Mtu RecA intein (*Mycobacterium Tuberculosis*, GenBank: AMC51766.1 (residue C252-N691)), the mini intein Msm DnaB-1 intein (*Mycolicibacterium smegmatis*, GenBank: CKI67314.1 (residue A238-N376)), the split intein Ssp DnaE intein (*Synechocystis* sp. strain PCC6803, UniProt ID: P74750 (residue C775-K897 and M898-N933)), and the split intein Neq Pol intein (*Nanoarchaeum equitans*, GenBank: AAR38923.1 (5579-N676) and GenBank: AAR39369.1 (residue M1-N30)).

In some embodiments, the intein is selected from PI-PfuI intein (UniProt ID: E7FHX6 (residue C302-N755), PDB ID: 1DQ3), PI-PfuII intein (UniProt ID: E7FHX6 (residue C915-N1296)), Tth-HB27 DnaE-1 intein (Uniprot ID: Q72GP2 (residue C768-N1190)), Neq Pol intein (GenBank: AAR38923.1 (5579-N676) and GenBank: AAR39369.1 (residue M1-N30), PDB ID: 5OXZ), Tmar Pol intein (UniProt ID: C7AIP4 (residue S492-N1028)), Tfu Pol-1 intein (UniProt ID: P74918 (residue C407-N777)), Tfu Pol-2 intein (UniProt ID: P74918 (residue S901-N1289)), Pab PolII intein (UniProt ID: Q9V2F4 (residue C955-Q1139), PDB ID: 2LCJ), Pho PolII intein (GenBank ID: BAA29190.1 (residue C955-Q1120)), Tsi PolII intein (UniProt ID: C6A4U4 (residue C949-Q1114)), Tga PolII intein (UniProt ID: C5A316 (residue C962-Q1125)), Tko PolII intein (UniProt ID: QSJET0 (residue C964-Q1437)), Tba PolII intein (UniProt ID: F0LKL3 (residue C952-N1426)), Psp-GBD Pol intein (UniProt ID: Q51334 (residue S493-N1029)), Pho CDC21-1 intein (GenBank ID: BAA29695.1 (residue C335-N502), PDB ID: 6RPQ), Pab CDC21-1 intein (GenBank ID CAB50345.1 (residue C335-N498), PDB ID: 6RPP), Tko CDC21-1 intein (GenBank: CAJ57164.1 (residue C1-N140)), Mja TFIIB intein (Uniprot ID: Q58192 (residue S100-N434), Mvu TFIIB intein (GenBank: ACX71902.1 (residue S93-N427)), Pho RadA intein (UniProt ID: 058001 (residue C153-N324), PDB ID: 4E2T), Tsi RadA intein (UniProt ID: C6A058 (residue C154-N321)), Mja KlbA intein (Uniprot ID: Q58191 (residue A405-N572), PDB ID: 2JMZ), Pho CDC21-2 intein (GenBank ID: BAA29695.1 (residue C530-N789)), Hsp CDC21 intein (GenBank ID: AAG20316.1 (residue C283-N464)), Hsp PolII intein (UniProt ID: Q9HMX8 (residue C926-Q1120)), Mth RIR1 intein (GenBank: AAB85157.1 (residue C266-N399)), Mxe GyrA intein (UniProt ID: P72065 (residue C66-N263), PDB ID: 1AM2), Tvo VMA intein (UniProt ID: Q97CQ0 (residue C236-N421), PDB ID: 401S), Tac VMA intein (GenBank ID: BAB00608.1 (residue C236-N408)), Sce VMA intein (alternative name: PI-SceI intein UniProt ID: P17255 (residue C284-N737), PDB ID: 1DFA), Ssp DnaE intein (UniProt ID: P74750 (residue C775-K897 and M898-N933), PDB ID: 1ZD7), Npu DnaE intein (GenBank ID: ACC83218.1 (residue C775-N876) and GenBank ID: ACC83986.1 (residue M1-N36)), Ssp DnaB intein (UniProt ID: Q55418 (residue C381-N809)), Npu DnaB intein (GenBank ID: ACC81364.1 (residue C389-817N)), Msm DnaB-1 intein (GenBank: CKI67314.1 (residue A238-N376)), Mtu RecA intein (GenBank: AMC51766.1 (residue C252-N691)), gp41-1 intein (PDB ID: 6QAZ), Tko Pol-2 intein (GenBank: BAA06142.2 (residue S852-N1388), PDB ID: 2CW8), Cth BIL intein (GenBank: ABN53254.1 (residue C311-N445), PDB ID: 2LWY), Cne PRP8 intein (GenBank: AAX38543.1 (residue C1-N171), PDB ID: 6MX6).

In some embodiments, the intein is a pH sensitive intein. In some embodiments, the intein is sensitive to a plurality of factors. For example, the intein may be sensitive to temperature and pH. The intein may be sensitive to temperature and one or more divalent metal ions. The intein may be sensitive to temperature and pH and one or more divalent metal ions. The intein may be sensitive to pH and one or more divalent metal ions. The intein may be sensitive to additional factors not listed herein.

Any large intein may be made into a mini intein by removal of the endonuclease domain. The intein may comprise an amino acid sequence having 80% or more (e.g. at least 80%, at least 81%, at least 82%, at least 83%, at least 84%, at least 85%, at least 86%, at least 94%, at least 95%, at least 96%, at least 97%, at least 98%, at least 99%, or 100%) sequence identity with an intein described herein. For large inteins, the intein may comprise an amino acid sequence having 80% or more sequence identity with a mini intein derived from the large intein.

In some embodiments, the intein is PI-PfuI intein or a variant thereof. The sequence of wildtype PI-PfuI intein is:

(SEQ ID NO: 4)
CIDGKAKIIFENEGEEHLTTMEEMYERYKHLGEFYDEEYNRWGIDVSNV
PIYVKSFDPESKRVVKGKVNVIWKYELGKDVTKYEIITNKGTKILTSPW
HPFFVLTPDFKIVEKRADELKEGDILIGGMPDGEDYKFIFDYWLAGFIA
GDGCFDKYHSHVKGHEYIYDRLRIYDYRIETFEIINDYLEKTFGRKYSI
QKDRNIYYIDIKARNITSHYLKLLEGIDNGIPPQILKEGKNAVLSFIAG
LFDAEGHVSNKPGIELGMVNKRLIEDVTHYLNALGIKARIREKLRKDGI
DYVLHVEEYSSLLRFYELIGKNLQNEEKREKLEKVLSNHKGGNFGLPLN
FNAFKEWASEYGVEFKTNGSQTIAIINDERISLGQWHTRNRVSKAVLVK
MLRKLYEATKDEEVKRMLHLIEGLEVVRHITTTNEPRTFYDLTVENYQN
YLAGENGMIFVHN

In some embodiments, the intein comprises an amino acid sequence having at least 80% sequence identity with SEQ ID NO: 4. For example, the intein may comprise an amino acid sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity with SEQ ID NO: 4.

In some embodiments, the intein comprises a mini intein derived from the wild-type PI-PfuI intein (e.g. the large intein). For example, in some embodiments the intein comprises an amino acid sequence having at last 80% sequence identity with the PI-PfuI mini intein having the amino acid sequence:

(SEQ ID NO: 6)
CIDGKAKIIFENEGEEHLTTMEEMYERYKHLGEFYDEEYNRWGIDVSNV
PIYVKSFDPESKRVVKGKVNVIWKYELGKDVTKYEIITNKGTKILTSPW
HPFFVLTPDFKIVEKRADELKEGDILIGGMPDGGLEVVRHITTTNEPRT
FYDLTVENYQNYLAGENGMIFVHN

In some embodiments, the intein comprises an amino acid sequence having at least 80%, at least 81%, at least 82%, at least 83%, at least 84%, at least 85%, at least 86%, at least 94%, at least 95%, at least 96%, at least 97%, at least 98%, at least 99%, or 100% identity with SEQ ID NO: 6.

The amino acid sequences of other suitable inteins (e.g. suitable inteins described above) are provided below. Any intein comprising an amino acid sequence having at least 80% sequence identity with a sequence provided below may be used in the fusion proteins described herein.

PI-PfuII intein (UniProt ID: E7FHX6 (residue C915-N1296), intein domain: C915-S1055 and T1256-N1296). Full length large intein:

(SEQ ID NO: 13)
CVVGDTRILTPEGYLKAEEIFSLAKERGKKEAVAVEGIAEEGEPYAYSV
EILLPGEEKVEYETVHGKVLAVADPVAVPAYVWKVGRKKVARVKTKEGY
EITATLDHKLMTPEGWKEVGKLKEGDKILLPRFEVEEEFGSESIGEDLA
FVLGWFIGDGYLNVNDKRAWFYFNAEKEEEIAVRIRDILVKHFGIKAEL
HRYGNQIKLGVRGEAYRWLENIVKNNEKRIPEIVYRLKPREIAAFLRGL
FSADGYVDKDMAIRLTSKSRELLREVQDLLLLFGILSKIYEKPYESEFH
YTTKNGEERIYRSKGYYELVITNYSRKLFAEKIGLEGYKMEKLSLKKTK
VDQPIVTVESVEVLGEEIVYDFTVPNYHMYISNGFMSHN

Mini intein derived from large intein:

(SEQ ID NO: 14)
CVVGDTRILTPEGYLKAEEIFSLAKERGKKEAVAVEGIAEEGEPYAYSV
EILLPGEEKVEYETVHGKVLAVADPVAVPAYVWKVGRKKVARVKTKEGY
EITATLDHKLMTPEGWKEVGKLKEGDKILLPRFEVEEEFGSESTKVDQP
IVTVESVEVLGEEIVYDFTVPNYHMYISNGFMSHN

Tth-HB27 DnaE-1 intein (Uniprot ID: Q72GP2 (residue C768-N1190), intein domain: C768-E874 and L1137-N1190). Full length large intein:

(SEQ ID NO: 15)
CLAEGSLVLDAATGQRVPIEKVRPGMEVFSLGPDYRLYRVPVLEVLESG
VREVVRLRTRSGRTLVLTPDHPLLTPEGWKPLCDLPLGTPIAVPAELPV
AGHLAPPEERVTLLALLLGDGNTKLSGRRGTRPNAFFYSKDPELLAAYR
RCAEALGAKVKAYVHPTTGVVTLATLAPRPGAQDPVKRLVVEAGMVAKA
EEKRVPEEVFRYRREALALFLGRLFSTDGSVEKKRISYSSASLGLAQDV
AHLLLRLGITSQLRSRGPRAHEVLISGREDILRFAELIGPYLLGAKRER
LAALEAEARRRLPGQGWHLRLVLPAVAYRVSEAKRRSGFSWSEAGRRVA
VAGSCLSSGLNLKLPRRYLSRHRLSLLGEAFADPGLEALAEGQVLWDPI
VAVEPAGKARTFDLRVPPFANFVSEDLVVHN

Mini intein derived from large intein:

(SEQ ID NO: 16)
CLAEGSLVLDAATGQRVPIEKVRPGMEVFSLGPDYRLYRVPVLEVLESG
VREVVRLRTRSGRTLVLTPDHPLLTPEGWKPLCDLPLGTPIAVPAELPV
AGHLAPPEELGEAFADPGLEALAEGQVLWDPIVAVEPAGKARTFDLRVP
PFANFVSEDLVVHN

Neq Pol intein (GenBank: AAR38923.1 (S579-N676) and GenBank: AAR39369.1 (residue M1-N30), PDB ID: 5OXZ). Natural split intein:

N-terminal fragment:

(SEQ ID NO: 17)
SIMDTEIEVIENGIKKKEKLSDLFNKYYAGFQIGEKHYAFPPDLYVVDG
ERWVKVYSIIKHETETDLYEINGITLSANHLVLSKGNWVKAKEYENKNN

C-terminal fragment:

(SEQ ID NO: 18)
MRYLGKKRVILYDLSTESGKFYVNGLVLHN

Mini intein derived from split intein:

(SEQ ID NO: 19)
SIMDTEIEVIENGIKKKEKLSDLFNKYYAGFQIGEKHYAFPPDLYVVDG
ERWVKVYSIIKHETETDLYEINGITLSANHLVLSKGNWVKAKEYENKNN
GGMRYLGKKRVILYDLSTESGKFYVNGLVLHN

Tmar Pol intein (UniProt ID: C7AIP4 (residue S492-N1028), intein domain: S492-E621 and S986-N1028). Full length large intein:

(SEQ ID NO: 20)
SLLPEEWIPVVENGKVKLVRIGEFVDGLMKDEKGRAKRDGNTEVLEVSG
IRAVSFDRKTKKARLMPVKAVIRHRYSGDVYKITLSSGRKITVTKGHSL
FAYRNGELVEVPGEEIKAGDLLAVPRRVHLPERYERLDLVELLLKLPEE
ETEDIILTIPAKGRKNFFKGMLRTLRWIFGEEKRPRTARRYLRHLEGLG
YVKLRKIGYEIIDREGLKRYRKLYERLAEVVRYNGNKREYLIEFNAVRD
VISLMPEEELNEWQVGTRNGFRIKPLIEVDEDFAKLLGYYVSEGYAGKQ
RNQKNGWSYTVKLYNEDERVLDDMENLAREFFGKARRGRNYVEIPRKMA
YIIFESLCGTLAENKRVPEVIFTSPEDVRWAFLEGYFIGDGDVHPSKRV
RLSTKSELLANGLVLLLNSLGVSAVKLGHDSGVYRVYVNEELPFTGYKK
KKNAYYSHVIPKEVLEETFGKVFQRNMSYEKFQELVESEKLEGEKAKRI
EWLISGDIILDKVVEVKKMNYEGYVYDLSVEEDENFLAGFGFLYAHN

Mini intein derived from large intein:

(SEQ ID NO: 21)
SLLPEEWIPVVENGKVKLVRIGEFVDGLMKDEKGRAKRDGNTEVLEVSG
IRAVSFDRKTKKARLMPVKAVIRHRYSGDVYKITLSSGRKITVTKGHSL
FAYRNGELVEVPGEEIKAGDLLAVPRRVHLPESGDIILDKVVEVKKMNY
EGYVYDLSVEEDENFLAGFGFLYAHN

Tfu Pol-1 intein (UniProt ID: P74918 (residue C407-N777), intein domain: C407-E518 and N718-N777). Full length large intein:

(SEQ ID NO: 22)
CHPADTKVIVKGKGVVNISEVREGDYVLGIDGWQKVQRVWEYDYEGELV
NINGLKCTPNHKLPVVRRTERQTAIRDSLAKSFLTKKVKGKLITTPLFE
KIGKIEREDVPEEEILKGELAGIILAEGTLLRKDVEYFDSSRGKKRVSH
QYRVEITVGAQEEDFQRRIVYIFERLFGVTPSVYRKKNTNAITFKVAKK
EVYLRVREIMDGIENLHAPSVLRGFFEGDGSVNKVRKTVVVNQGTNNEW
KIEVVSKLLNKLGIPHRRYTYDYTEREKTMTTHILEIAGRDGLILFQTI

-continued

VGFISTEKNMALEEAIRNREVNRLENNAFYTLADFTAKTEYYKGKVYDL
TLEGTPYYFANGILTHNSLYPSIIISHN

Mini intein derived from large intein:

(SEQ ID NO: 23)
CHPADTKVIVKGKGVVNISEVREGDYVLGIDGWQKVQRVWEYDYEGELV
NINGLKCTPNHKLPVVRRTERQTAIRDSLAKSFLTKKVKGKLITTPLFE
KIGKIEREDVPEEENREVNRLENNAFYTLADFTAKTEYYKGKVYDLTLE
GTPYYFANGILTHNSLYPSIIISHN

Tfu Pol-2 intein (UniProt ID: P74918 (S901-N1289), intein domain: S901-V1042 and D1228-N1289). Full length large intein:

(SEQ ID NO: 24)
SVTGDTEVTIRRNGRIEFVPIEKLFERVDHRVGEKEYCVLGGVEALTLD
NRGRLVWKKVPYVMRHKTDKRIYRVWFTNSWYLDVTEDHSLIGYLNTSK
VKPGKPLKERLVEVKPEELGGKVKSLITPNRPIARTIKANPIAVKLWEL
IGLLVGDGNWGGQSNWAKYYVGLSCGLDKAEIERKVLNPLREASVISNY
YDKSKKGDVSILSKWLAGFMVKYFKDENGNKAIPSFMFNLPREYIEAFL
RGLFSADGTVSLRRGIPEIRLTSVNRELSDAVRKLLWLVGVSNSLFTET
KPNRYLEKESGTHSIHVRIKNKHRFADRIGFLIDRKSTKLSENLGGHTN
KKRAYKYDFDLVYPRKIEEITYDGYVYDIEVEGTHRFFANGILVHN

Mini intein derived from large intein:

(SEQ ID NO: 25)
SVTGDTEVTIRRNGRIEFVPIEKLFERVDHRVGEKEYCVLGGVEALTLD
NRGRLVWKKVPYVMRHKTDKRIYRVWFTNSWYLDVTEDHSLIGYLNTSK
VKPGKPLKERLVEVKPEELGGKVKSLITPNRPIARTIKANPIAVDRKST
KLSENLGGHTNKKRAYKYDFDLVYPRKIEEITYDGYVYDIEVEGTHRFF
ANGILVHN

Pab PolII intein (UniProt ID: Q9V2F4 (residue C955-Q1139), PDB ID: 2LCJ). Natural mini intein:

(SEQ ID NO: 26)
CFPGDTRILVQIDGVPQKITLRELYELFEDERYENMVYVRKKPKREIKV
YSIDLETGKVVLTDIEDVIKAPATDHLIRFELEDGRSFETTVDHPVLVY
ENGRFIEKRAFEVKEGDKVLVSELELVEQSSSSQDNPKNENLGSPEHDQ
LLEIKNIKYVRANDDFVFSLNAKKYHNVIINENIVTHQ

Pho PolII intein (GenBank ID: BAA29190.1 (residue C955-Q1120)). Natural mini intein:

(SEQ ID NO: 27)
CFPGDTRILVQINGTPQRVTLKELYELFDEEHYESMVYVRKKPKVDIKV
YSFNPEEGKVVLTDIEEVIKAPATDHLIRFELELGSSFETTVDHPVLVY
ENGKFVEKRAFEVREGNIIIIIDESTLEPLKVAVKKIEFIEPPEDFVFS
LNAKKYHTVIINENIVTHQ

Tsi PolII intein (UniProt ID: C6A4U4 (residue C949-Q1114)). Natural mini intein:

(SEQ ID NO: 28)
CFPGETRILVQIDGFPQRITLKELYELFEDEHYENMVYVRKKPKADIKV
YSFDPETGKVVLTDIEDVIKAPITDHLIRFELELGRSFETTIDHPVLVY
ENGKFFKKRAFEVKESDIMVVIDESDSKPLKITIKKIEFVKPTGDFVFS
LNAKNYHNVLINENIVTHQ

Tga PolII intein (UniProt ID: C5A316 (residue C962-Q1125)). Natural mini intein:

(SEQ ID NO: 29)
CFPGDTRILVQIDGKPARITLRELYELFEGESYENMVYVRRKPKRDVKV
YSFDPERGKVVLTDIEDVIKAPSTDHLIRFELELGRSFETTVDHPVLVY
ENGKFVEKRAFEVKEGELIGVYENDSIKPFKIERIKYVKPKDDFVFSLN
AKSYHNVLINENVVTHQ

Tko PolII intein (UniProt ID: Q5JET0 (residue C964-Q1437), intein domain: C964-N1091 and K1386-Q1437). Full length large intein:

(SEQ ID NO: 30)
CFPGDTRILVQINGLPQRITLRELYDLFEDERYENMAYVRKKPKADVKV
YSFDPESGKVVLTDIEDVIKAPSTDHLIRFELELGRSFETTVDHPVLVY
ENGKFVEKRAFEVREGDRILVPNLKLPEKNIDYLDLLKEFSREEFAHLH
DRIMVRGIAEWLRSVEADVKEDYLRRDSIPLSVLLRVLTEKEISIEEVP
SCWLGFKRDKVRIKRFVPLKPLLRVVGYYLAEGYARESKSVYQLSFSMA
EKEVREDLKRALREAFGDGFGIYERGGKVTVGSRILYLLFTEVLKAGKN
AYSKRVPSLVFTLPREAVAEMLKAYFEGDGSALKSVPRVVAYSVNKALL
EDIETLLLAKFGIRGYYTFDNNANRGNARGRLYHVERGTEAPVSKVYAL
NIAGEHYHRFFNSIGFVSERKNSIYELHAEKSPAQDRYSSQNGWLVKVR
RIEYITPKDDFVFSLNAKKYHNVIINESIVTHQ

Mini intein derived from large intein:

(SEQ ID NO: 31)
CFPGDTRILVQINGLPQRITLRELYDLFEDERYENMAYVRKKPKADVKV
YSFDPESGKVVLTDIEDVIKAPSTDHLIRFELELGRSFETTVDHPVLVY
ENGKFVEKRAFEVREGDRILVPNLKLPEKNKSPAQDRYSSQNGWLVKVR
RIEYITPKDDFVFSLNAKKYHNVIINESIVTHQ

Tba PolII intein (UniProt ID: F0LKL3 (residue C952-N1426), intein domain: C952-S1082 and T1373-N1426) Full length large intein:

(SEQ ID NO: 32)
CFPGDTRILVQLNGMPQRITLRELYELFEEESYENMAYVRKKPKVDIKVY
SFDEESGKVVLTDIEDVIKLPSTDHLIRFELELGRSFETTVDHPVLVYEN
GRFIKKRAFEVKEGDLILVPKIEFPEEDIDSIDLLEEFSKDEFKELRERI
MVRGIAEWLMKIGAEVNPDYIRRNSIPLAVLLEVLKEKGLSIKDVPDCYI

-continued
GFKPDHVKIRRFVPIGPLLRLIGYYLAEGYARESDSVYQISFSNGDEEVR
EDIKRALRKAFGDGFGIYERGEKITVGSRVIYLLFTRVLKIGKGAKDKRV
PAFVFKLPKEKVRHLLQAYFEGDGTAIKSRPMIVVYSVNKPLLEDIDTLM
IAKFNLYASWGVDKNANSRPGNIVQRYHEHRGRRVPVSTVYRLDYYGIQA
KRFFEEIDFISERKNSVVNAWTNHKFQPYRRANEMGILVRVRRVEYVKPP
EEWVYSLSVAKYHTVIVSDNITTSN Mini intein derived from large intein:

(SEQ ID NO: 33)
CFPGDTRILVQLNGMPQRITLRELYELFEEESYENMAYVRKKPKVDIKVY
SFDEESGKVVLTDIEDVIKLPSTDHLIRFELELGRSFETTVDHPVLVYEN
GRFIKKRAFEVKEGDLILVPKIEFPEEDIDSTNHKFQPYRRANEMGILVR
VRRVEYVKPPEEWVYSLSVAKYHTVIVSDNITTSN

Psp-GBD Pol intein (UniProt ID: Q51334 (residue S493-N1029), intein domain: S493-E622 and N987-N1029). Full length large intein:

(SEQ ID NO: 34)
SILPEEWVPLIKNGKVKIFRIGDFVDGLMKANQGKVKKTGDTEVLEVAGI
HAFSFDRKSKKARVMAVKAVIRHRYSGNVYRIVLNSGRKITITEGHSLFV
YRNGDLVEATGEDVKIGDLLAVPRSVNLPEKRERLNIVELLLNLSPEETE
DIILTIPVKGRKNFFKGMLRTLRWIFGEEKRVRTASRYLRHLENLGYIRL
RKIGYDIIDKEGLEKYRTLYEKLVDVVRYNGNKREYLVEFNAVRDVISLM
PEEELKEWRIGTRNGFRMGTFVDIDEDFAKLLGYYVSEGSARKWKNQTGG
WSYTVRLYNENDEVLDDMEHLAKKFFGKVKRGKNYVEIPKKMAYIIFESL
CGTLAENKRVPEVIFTSSKGVRWAFLEGYFIGDGDVHPSKRVRLSTKSEL
LVNGLVLLLNSLGVSAIKLGYDSGVYRVYVNEELKFTEYRKKKNVYHSHI
VPKDILKETFGKVFQKNISYKKFRELVENGKLDREKAKRIEWLLNGDIVL
DRVVEIKREYYDGYVYDLSVDEDENFLAGFGFLYAHN

Mini intein derived from large intein:

(SEQ ID NO: 35)
SILPEEWVPLIKNGKVKIFRIGDFVDGLMKANQGKVKKTGDTEVLEVAGI
HAFSFDRKSKKARVMAVKAVIRHRYSGNVYRIVLNSGRKITITEGHSLFV
YRNGDLVEATGEDVKIGDLLAVPRSVNLPENGDIVLDRVVEIKREYYDGY
VYDLSVDEDENFLAGFGFLYAHN

Pho CDC21-1 intein (GenBank ID: BAA29695.1 (residue C335-N502), PDB ID: 6RPQ). Natural mini intein:

(SEQ ID NO: 36)
CVDYDTEVLLGDGRKRKIGEIVEEAIKKAEKEGKLGRVDDGFYAPINLEL
YALDVRTLKVRKVKADIAWKRTTPEKMLRIRTKRGREIRVTPTHPFFTLE
EGRIKTKKAYELKVGEKIATPREEAPEAEIFWDEVVEIEEYKPNNSWVYD
LQVPEHHNFIANGIFVHN

Pab CDC21-1 intein (GenBank ID CAB50345.1 (residue C335-N498), PDB ID: 6RPP). Natural mini intein:

(SEQ ID NO: 37)
CVDYETEVVLGNGERKKIGEIVERAIEEAEKNGKLGRVDDGFYAPIDIEV

YSLDLETLKVRKARANIAWKRTAPKKMMLVKTRGGKRIRVTPTHPFFVLE

EGKVAMRKARDLEEGNKIATIEGLSVSWDEVAEILEYEPKDPWVYDLQVP

GYHNFLANGIFVHN

Tko CDC21-1 intein (GenBank: CAJ57164.1 (residue C1-N140)). Natural mini intein:

(SEQ ID NO: 38)
CVAPDSIIKTNLGQFKIGELVEKAIPEKVQDYKSVNAEKLGLYIKTLDGD

MRVLRLWKLRAPEKLIRIEGDGLSITVTPETKLLTPNGWVEARNVDGEVV

TENGPVKVSKQEIESPHDYVYDLTVEGSHSFIANGFVVHN

Mja TFIIB intein (Uniprot ID: Q58192 (residue S100-N434), intein domain: S100-K220 and R376-N434, PDB ID: 5O9J). Full length large intein:

(SEQ ID NO: 39)
SVDYNEPIIIKENGEIKVVKIGELIDKIIENSENIRREGILEIAKCKGIE

VIAFNSNYKFKFMPVSEVSRHPVSEMFEIVVEGNKKVRVTRSHSVFTIRD

NEVVPIRVDELKVGDILVLAKELPNIEEDIEIDKKFSKILGYIIAEGYYD

DKKIVLSYDYNEKEFINETIDYFKSLNSDITIYSKDLNIQIEVKNKKIIN

LLKKLRVKNKRIPSIIFKSPYEIKKSFIDGIFNGKDAKVFVSKELAEDVI

FLLLQIKENATINKKSINDIEVYEVRRITNIYTNRKLEKLINSDFIFLKI

KEINKVEPTSGYAYDLTVPNAENFVAGFGGFVLHN

Mini intein derived from large intein:

(SEQ ID NO: 40)
SVDYNEPIIIKENGEIKVVKIGELIDKIIENSENIRREGILEIAKCKGIE

VIAFNSNYKFKFMPVSEVSRHPVSEMFEIVVEGNKKVRVTRSHSVFTIRD

NEVVPIRVDELKVGDILVLAKRITNIYTNRKLEKLINSDFIFLKIKEINK

VEPTSGYAYDLTVPNAENFVAGFGGFVLHN

Mvu TFIIB intein (GenBank: ACX71902.1 (residue S93-N427), intein domain: S93-E220 and N376-N427, PDB ID: 5091). Full length large intein:

(SEQ ID NO: 41)
SVDYSEPIIIKEKGEIKVVKIGELIDEIIKNSKNVRKDGILEIARCKDVE

VIAFDSNYKFKFMPVSEVSRHPVSEMFEIVVEGNKKVRVTGSHSVFTVKD

NEVVPIRVDDLRVGDILVLAKELPNIEEENAIDKKFAKILAYIVSEGYYN

EEKLIFSFNCNKREVIDEVISYFKSLKSEISIYNKNSDIQIEVKDKEIIN

ILKKLGIENKRVPSIIFKSPYGIKKSFIDGLFNGKDTKIFTSKELAEDAI

FLLLQIKENAILNKKIIKGISVYEVKRIPNIYNNRKLEKLINSDFIFLKI

KKINKVEPTNGYAYDLTVPNAENFIAGFGGFVLHN

Mini intein derived from large intein:

(SEQ ID NO: 42)
SVDYSEPIIIKEKGEIKVVKIGELIDEIIKNSKNVRKDGILEIARCKDVE

VIAFDSNYKFKFMPVSEVSRHPVSEMFEIVVEGNKKVRVTGSHSVFTVKD

NEVVPIRVDDLRVGDILVLAKELPNIEENRKLEKLINSDFIFLKIKKINK

VEPTNGYAYDLTVPNAENFIAGFGGFVLHN

Pho RadA intein (UniProt ID: 058001 (residue C153-N324), PDB ID: 4E2T). Natural mini intein:

(SEQ ID NO: 43)
CFARDTEVYYENDTVPHMESIEEMYSKYASMNGELPFDNGYAVPLDNVFV

YTLDIASGEIKKTRASYIYREKVEKLIEIKLSSGYSLKVTPSHPVLLFRD

GLQWVPAAEVKPGDVVVGVREEVLRRRIISKGELEFHEVSSVRIIDYNNW

VYDLVIPETHNFIAPNGLVLHN

Tsi RadA intein (UniProt ID: C6A058 (residue C154-N321)). Natural mini intein:

(SEQ ID NO: 44)
CFAKDTTVYYENDDVAHVESIEEMYNKYATKNGEIPFDNGFAVPLEVVSV

YTFNIKTRKVEKTKVSYIYKEKVSTLVKLKLSTGIELKVTQSHPVLVFKD

GLKWIKASEVQIGDRVVGIGEVPPKSEVNLRFHQVESVEIFDYNDYVYDL

VVPETHNFIAPNGLILHN

Mja KlbA intein (Uniprot ID: Q58191 (residue A405-N572), PDB ID: 2JMZ). Natural mini intein:

(SEQ ID NO: 45)
ALAYDEPIYLSDGNIINIGEFVDKFFKKYKNSIKKEDNGFGWIDIGNENI

YIKSFNKLSLIIEDKRILRVWRKKYSGKLIKITTKNRREITLTHDHPVYI

SKTGEVLEINAEMVKVGDYIYIPKNNTINLDEVIKVETVDYNGHIYDLTV

EDNHTYIAGKNEGFAVSN

Pho CDC21-2 intein (GenBank ID: BAA29695.1 (residue C530-N789)). Natural mini intein:

(SEQ ID NO: 46)
CVAPDTLINTDNGRVEIGKFVEEWMKEVGEISEEGISYAPCFRKVETFKD

GKIVESPIRRVWKLRAPKKLVRIKTENGRSIALTRETKLLTINDGELSWV

EAGEVKVGTYVGTVKSEKDVIPGAGKTIRDVSKLYNMEMEVKDYLTREEV

RKAIEKLEEIMNPMNIKIPGVQESYEELLRKLETTNDERVRNETLILLSD

VSDAHELAKEKIEKIKEIVNSEVHWEKVTEVGEVDGVEYVYDLTVEGSHN

FVANGFIVHN

Hsp CDC21 intein (GenBank ID: AAG20316.1 (residue C283-N464)). Natural mini intein:

(SEQ ID NO: 47)
CVRGDTTVALADGSEREIRDLVEANLDDPRPVDDGVWDGVDVAVPSLAA

DGRLVQRRATKVWKREAPETMYRVRTAAGHRLTVTPSHPLFVAGSHGPD

-continued

AVRTEDLEVGQLVGVAPDGDGSGQVAPDGGVIRDAQPAPVGDAETVAWS

AIESITEVEPDEEWVYDLEVEGTHSYLTDGVVSHN

Hsp PolII intein (UniProt ID: Q9HMX8 (residue C926-Q1120)). Natural mini intein:

(SEQ ID NO: 48)
CFHPETNVWFRDESGEWHHDPIETLVEARLDPDTADEDDFGALVQALDG

DVFVPSVTEDGEETLQRVEAVSKHPAPDHLLAVETKRGRELTVTPDHSM

RRWTGDGIERVDARELTAGDALPAPTQVPGDGETATSELRSESLDGTHP

QRRFGDGGSVRTDEVVSVEPVRSSVDHTYSLTVAETNTLVANGLFTGQ

Mth RIR1 intein (GenBank: AAB85157.1 (residue C266-N399)). Natural mini intein:

(SEQ ID NO: 49)
CVSGDTIVMTSGGPRTVAELEGKPFTALIRGSGYPCPSGFFRTCERDVY

DLRTREGHCLRLTHDHRVLVMDGGLEWRAAGELERGDRLVMDDAAGEFP

ALATFRGLRGAGRQDVYDATVYGASAFTANGFIVHN

Mxe GyrA intein (UniProt ID: P72065 (residue C66-N263), PDB ID: 1AM2). Natural mini intein:

(SEQ ID NO: 50)
CITGDALVALPEGESVRIADIVPGARPNSDNAIDLKVLDRHGNPVLADR

LFHSGEHPVYTVRTVEGLRVTGTANHPLLCLVDVAGVPTLLWKLIDEIK

PGDYAVIQRSAFSVDCAGFARGKPEFAPTTYTVGVPGLVRFLEAHHRDP

DAQAIADELTDGRFYYAKVASVTDAGVQPVYSLRVDTADHAFITNGFVS

HN

Tvo VMA intein (UniProt ID: Q97CQ0 (residue C236-N421), PDB ID: 401S). Natural mini intein:

(SEQ ID NO: 51)
CVSGETPVYLADGKTIKIKDLYSSERKKEDNIVEAGSGEEIIHLKDPIQ

IYSYVDGTIVRSRSRLLYKGKSSYLVRIETIGGRSVSVTPVHKLFVLTE

KGIEEVMASNLKVGDMIAAVAESESEARDCGMSEECVMEAEVYTSLEAT

FDRVKSIAYEKGDFDVYDLSVPEYGRNFIGGEGLLVLHN

Tac VMA intein (GenBank ID: BAB00608.1 (residue C236-N408)). Natural mini intein:

(SEQ ID NO: 52)
CVSGDTPVLLDAGERRIGDLFMEAIRPKERGEIGQNEEIVRLHDSWRIY

SMVGSEIVETVSHAIYHGKSNAIVNVRTENGREVRVTPVHKLFVKIGNS

VIERPASEVNEGDEIAWPSVSENGDSQTVTTTLVLTFDRVVSKEMHSGV

FDVYDLMVPDYGYNFIGGNGLIVLHN

Sce VMA intein (alternative name: PI-SceI intein, UniProt ID: P17255 (residue C284-N737), intein domain: C284-P465 and A693-N737, PDB ID: 1DFA). Full length large intein:

(SEQ ID NO: 53)
CFAKGTNVLMADGSIECIENIEVGNKVMGKDGRPREVIKLPRGRETMYS

VVQKSQHRAHKSDSSREVPELLKFTCNATHELVVRTPRSVRRLSRTIKG

VEYFEVITFEMGQKKAPDGRIVELVKEVSKSYPISEGPERANELVESYR

KASNKAYFEWTIEARDLSLLGSHVRKATYQTYAPILYENDHFFDYMQKS

KFHLTIEGPKVLAYLLGLWIGDGLSDRATFSVDSRDTSLMERVTEYAEK

LNLCAEYKDRKEPQVAKTVNLYSKVVRGNGIRNNLNTENPLWDAIVGLG

FLKDGVKNIPSFLSTDNIGTRETFLAGLIDSDGYVTDEHGIKATIKTIH

TSVRDGLVSLARSLGLVVSVNAEPAKVDMNGTKHKISYAIYMSGGDVLL

NVLSKCAGSKKFRPAPAAAFARECRGFYFELQELKEDDYYGITLSDDSD

HQFLLANQVVVHN

Mini intein derived from large intein:

(SEQ ID NO: 54)
CFAKGTNVLMADGSIECIENIEVGNKVMGKDGRPREVIKLPRGSETMYS

VVQKSQHRAHKSDSSREMPELLKFTCNATHELVVRTPRSVRRLSRTIKG

VEYFEVITFEMGQKKAPDGRIVELVKEVSKSYPVSEGPERANELVESYR

KASNKAYFEWTIEARDLSLLGSHVRKATYQTYAPIGAAFARECRGFYFE

LQELKEDDYYGITLSDDSDHQFLLANQVVVHN

Ssp DnaE intein (UniProt ID: P74750 (residue C775-K897 and M898-N933), PDB ID: 1ZD7). Natural split intein:

N-terminal fragment:
(SEQ ID NO: 55)
CLSFGTEILTVEYGPLPIGKIVSEEINCSVYSVDPEGRVYTQAIAQWHD

RGEQEVLEYELEDGSVIRATSDHRFLTTDYQLLAIEEIFARQLDLLTLE

NIKQTEEALDNHRLPFPLLDAGTIK

C-terminal fragment:
(SEQ ID NO: 56)
MVKVIGRRSLGVQRIFDIGLPQDHNFLLANGAIAAN

Mini intein derived from split intein:

(SEQ ID NO: 57)
CLSFGTEILTVEYGPLPIGKIVSEEINCSVYSVDPEGRVYTQAIAQWHD

RGEQEVLEYELEDGSVIRATSDHRFLTTDYQLLAIEEIFARQLDLLTLE

NIKQTEEALDNHRLPFPLLDAGTIKMVKVIGRRSLGVQRIFDIGLPQDH

NFLLANGAIAAN

Npu DnaE intein (GenBank ID: ACC83218.1 (residue C775-N876) and GenBank ID: ACC83986.1 (residue M1-N36)). Natural split intein:

N-terminal fragment:
(SEQ ID NO: 58)
CLSYETEILTVEYGLLPIGKIVEKRIECTVYSVDNNGNIYTQPVAQWHD

RGEQEVFEYCLEDGSLIRATKDHKFMTVDGQMLPIDEIFERELDLMRVD

NLPN

-continued

C-terminal fragment:

(SEQ ID NO: 59)
MIKIATRKYLGKQNVYDIGVERDHNFALKNGFIASN

Mini intein derived from split intein:

(SEQ ID NO: 60)
CLSYETEILTVEYGLLPIGKIVEKRIECTVYSVDNNGNIYTQPVAQWHD

RGEQEVFEYCLEDGSLIRATKDHKFMTVDGQMLPIDEIFERELDLMRVD

NLPNIKIATRKYLGKQNVYDIGVERDHNFALKNGFIASN

Ssp DnaB intein (UniProt ID: Q55418 (residue C381-N809), intein domain: C381-L486 and S762-N809). Full length large intein:

(SEQ ID NO: 61)
CISGDSLISLASTGKRVSIKDLLDEKDFEIWAINEQTMKLESAKVSRVF

CTGKKLVYILKTRLGRTIKATANHRFLTIDGWKRLDELSLKEHIALPRK

LESSSLQLMSDEELGLLGHLIGDGCTLPRHAIQYTSNKIELAEKVVELA

KAVFGDQINPRISQERQWYQVYIPASYRLTHNKKNPITKWLENLDVFGL

RSYEKFVPNQVFEQPQRAIAIFLRHLWSTDGCVKLIVEKSSRPVAYYAT

SSEKLAKDVQSLLLKLGINARLSKISQNGKGRDNYHVTITGQADLQIFV

DQIGAVDKDKQASVEEIKTHIAQHQANTNRDVIPKQIWKTYVLPQIQIK

GITTRDLQMRLGNAYCGTALYKHNLSRERAAKIATITQSPEIEKLSQSD

IYWDSIVSITETGVEEVFDLTVPGPHNFVANDIIVHN

Mini intein derived from large intein:

(SEQ ID NO: 62)
CISGDSLISLASTGKRVSIKDLLDEKDFEIWAINEQTMKLESAKVSRVF

CTGKKLVYILKTRLGRTIKATANHRFLTIDGWKRLDELSLKEHIALPRK

LESSSLQLSPEIEKLSQSDIYWDSIVSITETGVEEVFDLTVPGPHNFVA

NDIIVHN

Npu DnaB intein (GenBank ID: ACC81364.1 (residue C389-817N), intein domain: C389-L481 and S779-N817). Full length large intein:

(SEQ ID NO: 63)
CLAGDSLVTLVDSGLQVPIKELVGKSGFAVWALNEATMQLEKAIVSNAF

STGIKPLFTLTTRLGRKIRATGNHKFLTINGWKRLDELTPKEHLCLPRN

LPSSGKQTMTYAEVALLGHLIGDGCTLPRHAIQYTTREIDLAQNVAFLA

TEVFGDSIVPRISPEREWYQVYLSAAQHLTHSVRNPIAKWLDSLNVFGL

RSYEKFVPRELFSQPKELIACFLRHLWSTDGCINLIAGKKPRPIAFYAS

SSERLAFDVQTLLLRLGINATLRTVPQVGKGRNQYHVIITGKPDLQLFI

VHVGAVGQYKLRSLQDIFQHLENSIHNPNRDIIPKDIWKMEVVPAMQAI

GFTTRILQASIGVSYCGSTLYKVNLSRERALKVGNIVQSSKLVTLAKSD

VYWDEIVSIEYSGEEEVFDLTVPGLHNFVANNIIVHN

Mini intein derived from large intein:

(SEQ ID NO: 64)
CLAGDSLVTLVDSGLQVPIKELVGKSGFAVWALNEATMQLEKAIVSNAFS

TGIKPLFTLTTRLGRKIRATGNHKFLTINGWKRLDELTPKEHLALPRNSG

SDIYWDEIVSIEYSGEEEVFDLTVPGLHNFVANNIIVHN

Msm DnaB-1 intein (GenBank: CKI67314.1 (residue A238-N376)). Natural mini intein:

(SEQ ID NO: 65)
ALALDTPLPTPSGWTTMGDVAVGDHLLGPDGEPTRVVADTDVMLGRPCYV

VEFSDGTAIVADAQHQWPTEHGVRITANLRAGMHTVVSASGGRGGTALLA

PAVQITAVRRRPSVPVRCVEVDNPEHLYLAGPGMVPTHN

Mtu RecA intein (GenBank: AMC51766.1 (residue C252-N691), intein domain: C252-A345 and E654-N691). Full length large intein:

(SEQ ID NO: 66)
CLAEGTRIFDPVTGTTHRIEDVVDGRKPIHVVAAAKDGTLHARPVVSWFD

QGTRDVIGLRIAGGAIVWATPDHKVLTEYGWRAAGELRKGDRVAQPRRFD

GFGDSAPIPADHARLLGYLIGDGRDGWVGGKTPINFINVQRALIDDVTRI

AATLGCAAHPQGRISLAIAHRPGERNGVADLCQQAGIYGKLAWEKTIPNW

FFEPDIAADIVGNLLFGLFESDGWVSREQTGALRVGYTTTSEQLAHQIHW

LLLRFGVGSTVRDYDPTQKRPSIVNGRRIQSKRQVFEVRISGMDNVTAFA

ESVPMWGPRGAALIQAIPEATQGRRRGSQATYLAAEMTDAVLNYLDERGV

TAQEAAAMIGVASGDPRGGMKQVLGASRLRRDRVQALADALDDKFLHDML

AEELRYSVIREVLPTRRARTFDLEVEELHTLVAEGVVVHN

Mini intein derived from large intein:

(SEQ ID NO: 67)
CLAEGTRIFDPVTGTTHRIEDVVDGRKPIHVVAAAKDGTLHARPVVSWFD

QGTRDVIGLRIAGGAIVWATPDHKVLTEYGWRAAGELRKGDRVAVRDVET

GELRYSVIREVLPTRRARTFDLEVEELHTLVAEGVVVHN gp41-1 intein (PDB ID: 6QAZ). Mini intein:

(SEQ ID NO: 68)
CLDLKTQVQTPQGMKEISNIQVGDLVLSNTGYNEVLNVFPKSKKKSYKIT

LEDGKEIICSEEHLFPTQTGEMNISGGLKEGMCLYVKEMMLKKILKIEEL

DERELIDIEVSGNHLFYANDILTHN

Tko Pol-2 intein (GenBank: BAA06142.2 (residue S852-N1388), intein domain: S852-E978 and G1347-N1388 PDB ID: 2CW8). Full length large intein:

(SEQ ID NO: 69)
SILPEEWLPVLEEGEVHFVRIGELIDRMMEENAGKVKREGETEVLEVSGL

EVPSFNRRTNKAELKRVKALIRHDYSGKVYTIRLKSGRRIKITSGHSLFS

VRNGELVEVTGDELKPGDLVAVPRRLELPERNHVLNLVELLLGTPEEETL

-continued

DIVMTIPVKGKKNFFKGMLRTLRWIFGEEKRPRTARRYLRHLEDLGYVRL

KKIGYEVLDWDSLKNYRRLYEALVENVRYNGNKREYLVEFNSIRDAVGIM

PLKELKEWKIGTLNGFRMRKLIEVDESLAKLLGYYVSEGYARKQRNPKNG

WSYSVKLYNEDPEVLDDMERLASRFFGKVRRGRNYVEIPKKIGYLLFENM

CGVLAENKRIPEFVFTSPKGVRLAFLEGYFIGDGDVHPNKRLRLSTKSEL

LANQLVLLLNSVGVSAVKLGHDSGVYRVYINEELPFVKLDKKKNAYYSHV

IPKEVLSEVFGKVFQKNVSPQTFRKMVEDGRLDPEKAQRLSWLIEGDVVL

DRVESVDVEDYDGYVYDLSVEDNENFLVGFGLVYAHN

Mini intein derived from large intein:

(SEQ ID NO: 70)

SILPEEWLPVLEEGEVHFVRIGELIDRMMEENAGKVKREGETEVLEVSGL

EVPSFNRRTNKAELKRVKALIRHDYSGKVYTIRLKSGRRIKITSGHSLFS

VRNGELVEVTGDELKPGDLVAVPRRLEGGDVVLDRVESVDVEDYDGYVYD

LSVEDNENFLVGFGLVYAHN

Cth BIL intein (GenBank: ABN53254.1 (residue C311-N445), PDB ID: 2LWY). Natural mini intein:

(SEQ ID NO: 71)

CFVAGTMILTATGLVAIENIKAGDKVIATNPETFEVAEKTVLETYVRETT

ELLHLTIGGEVIKTTFDHPFYVKDVGFVEAGKLQVGDKLLDSRGNVLVVE

EKKLEIADKPVKVYNFKVDDFHTYHVGDNEVLVHN

Cne PRP8 intein (GenBank: AAX38543.1 (residue C1-N171), PDB ID: 6MX6). Natural mini intein:

(SEQ ID NO: 72)

CLQNGTRLLRADGSEVLVEDVQEGDQLLGPDGTSRTASKIVRGEERLYRI

KTHEGLEDLVCTHNHILSMYKERFGREGAHSPSAGTSLTESHERVDVTVD

DFVRLPQQEQQKYKLFRSTDFVRREQPSASKLATLLHINSIELEEEPTKW

SGFVVDKDSLYLRYDYLVLHN

In some embodiments, the intein comprises an amino acid sequence having at least 80% sequence identity (at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity) with one or more of SEQ ID NO: 13-72.

Other suitable inteins are provided in Table 1 below. An intein used in the fusion proteins described herein may comprise an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity) with an amino acid sequence provided in Table 1 (e.g. one of SEQ ID NO: 73-127. The inteins in Table 1 satisfy the following criteria: 1) is from thermophilic organisms, and 2) the +1 position of extein is threonine (+1T-intein). The −1 and +1 extein residues are included for all sequences in the table. The inteins from thermophilic organisms may be temperature sensitive or may be engineered (e.g. mutated) to enhance temperature sensitivity and are thereby desirable for use in the fusion proteins described herein. The insertion positions contemplated herein contain a relatively conserved threonine, and therefore the +1T-inteins below can be directly used in the fusion proteins described herein without further engineering.

1. Table 1

| | |
|---|---|
| Dge DnaB | KCVTADTLIDVPGTGERITVEAFVRRQWPVVLSVSADGRVR<br>ESRVGAWIDSGVKPVRRVTTRTGRVVETTPHHPFLGVDGW<br>TPLYDLKVGDRIAVPRAVPVFGQRDVLSAERVRLLAYLLAE<br>GGLTQSGPRWTNADPELVQDFRACLAAEFPEVEMMADAW<br>TGIDDRLSRRWQPGERQDRPNPLIGWLRELGVWGQPTDAK<br>RFPAVVWTFTRPSLAAFLRVLLSCDGTLSTLAGKARIEFTVA<br>SEGLARDVHHALVRFGIVSKLWRKGERSWRVEITDPRSVA<br>DYQLQIGWLGEKALRTIPVSAETRSHVGHPPAGAWAHVRR<br>AAGERTASGFNAHTGRSLPQSRAARYAAVLDDTQLTLLGS<br>DALYWDDIVSIEDVGERQVYDLTVPGDANFIAADICLHNT<br>(SEQ ID NO: 73) |
| Hhal DnaB | KCLAYDAEIVQADGGVKTIEQIVRERRAHLATVGADWRLT<br>WTEPCDYVDDGHKPVFEVTTRLGRRIETTLTHPFLTVHGW<br>QRLEDLAEGDAIGVPRQLPVFGQEPIRDCEVRLLGHLIGDGG<br>LTGSPPRLTSGQEAMTADFLEAVDAFGGVEAKPIRASRRTQ<br>SWVVVGAAQARAAARSSFASLVDALIRRSPLTGRAIARNLG<br>VAPATLTYWRQGVNVPDAAMVGLLAGELGVDVGELRPEP<br>VARRNDRNPLQAWLDRLGLAGKSAHEKTVPDCVFRLPREQ<br>LARFLNRLFSSDGWVTHLASGQGQIGYTTVSEALARQIQHL<br>LLRFGVLAKLRHRSVRYQDGRRPAWQLDITHAESILTFAEQI<br>GILGKEQRLASVAASVRGRRRQSHTDHIPCEIWQFIDRARGE<br>WTWAELARRAGVASSNIHAYRRGMSRQRLAAFADALGSR<br>ELRQLASSDLYWDRIASIRPLGHKQVYDLTIPETHNFIANDV<br>CVHNT (SEQ ID NO: 74) |
| Hvo PolB | DSVTGDRPVVVRDPGGTVRILPIEDLFARGTTESEVLIAADG<br>DVVASATPGKTRRALDGWDALSVNEDGEAEWQPIAQAIRH<br>NTDKPVVNLQHKFGESTTTRDHSYVVPGEDGLTTVSPDDV<br>AEPYRVSGVPDVEPVEQVDVYEVLRGYEREYEDGRSVGSD<br>NSITKRKQIHADDEYVWFGHEHHRDVDSTVKVKRFVDIDSE<br>DGAALIRLLGAYVPEGSASTGETATSKFGASLAESDREWLA |

-continued

| 1. Table 1 | |
|---|---|
| | QLQRDYSRLFENTTAGIITSDRRAERTVEYQTDTGGASVTY NDETLKLQMMNELAAVFFREFAGQTSRGKRIPSFVFHLPEE KQDLFLTLLVEGDGSREFPRYTEAYAQRNFDFETTSRELAA GLSMLLTQRGQKHSLKYRDSKDSYTIRTCSTYREGRDPVLT EADHDGYVYDLSVEENENFVDGVGGIVLHNT (SEQ ID NO: 75) |
| Hwa MCM-2 | LCVTGETRIHTTDGFVPLKQLATQHHPKKVTTETAAAYERE LYTVDPTTQSAEVTQSKSSHVWRMPEKHCRRIRTASGKQLE ASVNTPVLTVDDAEIKWKPISAIESNDSVVIPQYNNVERSSV SITDIFEFTQEQLKLTEKSITILRTEIVSQYQNIAAAADALNID VNSVEALITGQPVVSDVIDRVCDAISVSSEDITIHHVIGPTGT AIELPEVLNDDLLYLLGAAFACGNIMTGETCEERWIQFHAP EESIRSHIIDAAVATFGSESIQTDTEQANTVQVISATVTRLFET LGLEQITDAAPREIHPRLTAVSGADAFIRGLFDTGGRIDNKN TPQIAIGTASEPLAEQIQLLLETYGIGSCRDTGDQSHTGTSTT QGQYLTLTGSDAQAYRTTIGTRTDSGSSWDRQVSSSHADSE PSVRSTTTDTRKRTDMHEHEIISAGDVSTVSSVESDGGTPQM PRSNIEPQSIGYDYESSRVNEIQTETVVEAVNTGKKEVFDLT VPNTQNFIGGGIVTHNT (SEQ ID NO: 76) |
| Hwa PolB-3 | DSVTGDRPVVVRDPSDYIQIVPIKLLFEQATAPEQNMRLTAD GAPSVNSELPKERRHLDQWEALSLSDTGETEWQPINQIIRHQ TDKEILTLQHEYGESTTTRDHSYITADDGEYVETSPENVDEP LPIPNIASVKTIETIDIYQTLTTDTQAQIGNDTEPDKWLPSAD CIHANDEYVWIGTTDKQQDRDDSTPAIPRYIDLTSDTGHALI RFLAVYLSDWSKSTITTTERGQCLHITGPQESALKTCAADA DQLFTHITPSIAVDAESNTNTVDSGFRCHIPTTLATTLISAFA GHPAHTKQIPSIVYHLPAAEQSLFIRHLIQAESTPESDGVSGR PQKSDKPILLENEFITTNRELAAGVSMLLTQCGQSYTISKQD TKGAYTIHINNSSSSGCTPTLTETTHSGYVYDLSVATNQNFV DGLGGLVLHNT (SEQ ID NO: 77) |
| Hwa RCF | KCVTGSTPILTNKGIRQIGEIVGDVDGFAPAPQNLKVCSLTA DGSFQYRHPSHVFGKRASGLQRIKTNDGATLTVTPEHKLLI RTGENTNPTWVPAADITAGMHVLRAKNLPIPAETTGSCAAS KNASEVSHIGDEYRYHDSLMADVNTRIATLERLIEDYAESR SDGSLKFTLIGAHTPTVSTVSYLLATVGIASRHTSTLIDSEKR VHAIIIDASDTVRLEEMIETDWDTVMADQTTTVTSSSTASTT KTTQSYLSSGETQTCGWIPYADGGVTHPSTQHSPLHADVVT VSESLDAEKRVYDLTVPGVRNYVGGCIPTVMHNT (SEQ ID NO: 78) |
| Hwa RIR1-2 | GCVEENSLVSTDEGLRPIKDLDNTTAEFEQWDEIDVGVTTD GGTKTATAVYDNGFANVRQIQTESGFNIAATPNHRFRTLSS DGTYTWKEAGKFESGDRVILQRNTFDAGSRVSLEANERAD DAQDTTEGPELPGRMTSELAEFLGYFMGSGYISDETHASVD LVVDSDATELNSYLSNLGEQLFRITPAVESQEMSQVLSFRDC HLSRYFEDNGWKKTDTGHNGDASAAFVPEQILEGDEQVVN GFLRGVFEAIGTVSEKIEILTTSTTLADQLQSLLLSLGHVFTR DSTKLVETNNYHDDQLRQRLCGATRREDERFMNEIGSLIEP DELNLSTRADKNDTYPSSVIDHVQTLDGYDSVSESLKSRINQ SQVDGTVSRKLIKDIEAETAETVSIADHELTGFYAATVESVT EDTAYTKDISVPSNNTYIADGFVTHNT (SEQ ID NO: 79) |
| Hwa rPol A" | MSIEADESIVIRRDGETELTEIGSFVDTILAADNQETRITDGH EIALAPNGLEVPSLDTDEQIRWKHIEAVSRHASPDEILLIELE SGRSIRATKAHSFVTRRDGDVLPVAGETLVVGDVLPTVGSY DHASGSISVPLQSQSVAADGGTVEPNTNITANAERDSASITS AGIIGSATWERISSIETVAPEYEYVYDLSVSGLETFTTGEGVV THNT (SEQ ID NO: 80) |
| Maeo RNR | QSLVKDELIFIKDNEKLKICKIGEYINEVMEKYNEKITVNGD TEILYLDEKDEVYTISVNINTGKTEFKRVYALSRHKPHNKIY KVVGKDGTTVSITEDHSLFNYNENGQLVQVKPKEMSHIIRN FDNPYTIEYKIGDLISTEYARSDSKYNSRQNDIPENIEITKELC QFLGLFVAEGSYGTNSIRISTTDDDVVKFIEKFLKNINENITL TIEKENNILFTNKGVYEFIKNVICINSGAPNKNIPEFILKGDKE IKQAFLGGLISGDGYISKDGRVQIYTTSEQLLGQLHILLSGLN MMYSINKVNEEGERVKIKGIESQRNHKLYVIEIAKNSTDVL DEYIIPKCKKDRIKGSDYEQLSYDYRIIKEYLRNIADKKPCD DYAWKSSNRKLKLTTLEKIEEMNPELRDEITKFKLNVPFEIK EIKETDYEEYVYDLSVEDNENFITATGILCHNT (SEQ ID NO: 81) |

-continued

| 1. Table 1 | |
|---|---|
| Mfe-AG86 Pol-2 | DSVTENTEIIVKINGEIKFMKIKDLFKKVDYAVGEKEYCLLD<br>DVYALTLNDDGKLIWKKVPYVMRHRANKDIYRVWITNTW<br>YVDVTEDHSLIGYLNTTKKRNAKKIGDRFIEIKPNNLGKDV<br>KSLITINNSLVDDKPVNNISIRFWELVGLLIGDGSWGGKTNS<br>AKYYLRLSAGLDKDEIIKKVLEPLKEIGVISNYYLENEKGDI<br>RILSKKLVRFMNKFKDENNKKIIPKFMFKLSKRKIEAFLRGL<br>FSADGTVIVRRGNAEIRFTNTNENIIENVRKLLYLVGISNSVF<br>KENNPNKYKGKVSKTFSYHINIKNKIRFAERVGFILDRKNER<br>LINLNNKWKSTIRNYDFDIARVKKIEKIDYNGYVYDIEVEDT<br>HRFFANGILVHNT (SEQ ID NO: 82) |
| Mja IF2 | KCLMPHEKVLTEYGEIKIEDLFKIGKEIVEKDELKEIRKLNIK<br>VHTLNENGEIKIINAPYVWKLKHKGKMIKVKLKNWHSITTT<br>PEHPFLTNNGWIKAENIKKGMYVAIPRKIYGNEDFEKFIEFIN<br>SKILTNELIVKVNEKDLKNVELPSTKIYKKQKNVFRSEDIIEH<br>NLNIEKISFSPRIHRCGKPQHYIKLPKSLNEWKAIFYFAGVMF<br>GDGCVDRIANNDEEVENKLKSLNNLGIEVERIKRKSSYEIIF<br>KNGKNALINLLKILFDYPSEKKSHNIKIPQILYIAPKELVAEFI<br>KGYFDADGYVNLRQNRIEVISASKEFIEGLSILLLRFEITSKIY<br>EIKKSYKETKKKYYQLNIVGKRNLKNFKNIGFSIKYKEENL<br>NKIIEKSRKSEKYPINKDMKRLRILFGMTRNEVNVSYYAKY<br>ENGKEIPSYEIVKKFLNSLKPKNLDKKIKVLEGKERDVNYL<br>KAFESDGLIENGRLTKLGREALNIWKNHEFGKENIDYMKSL<br>IENIAFVEVEDVEIIDYDGYVYDLTTETHNFIANGIVVHNT<br>(SEQ ID NO: 83) |
| Mja RFC-1 | KCLTGDTKVIVNGEIREIGEVIEEISNGKFGVTLTNNLKVLGI<br>DEDGKIREFDVQYVYKDKTNTLIKIKTKMGRELKVTTYHPL<br>LINHKNGEIKWEKAENLKVGDKLATPRYILFNESDYNEELA<br>EWLGYFIGDGHADKESNKITFTNGDEKLRKRFAELTEKLFK<br>DAKIKERIHKDRTPDIYVNSKEAVEFIDKLGLRGKKADKVRI<br>PKEIMRSDALRAFLRAYFDCDGGIEKHSIVLSTASKEMAEDL<br>VYALLRFGIIAKLREKVNKNNNKVYYHIVISNSSNLRTFLDN<br>IGFSQERKLKKLLEIIKDENPNLDVITIDKEKIRYIRDRLKVKL<br>TRDIEKDNWSYNKCRKITQELLKEIYYRLEELKEIEKALEENI<br>LIDWDEVAERRKEIAEKTGIRSDRILEYIRGKRKPSLKNYIKI<br>ANTLGKNIEKIIDAMRIFAKKYSSYAEIGKMLNMWNSSIKIY<br>LESNTQEIEKLEEIRKTELKLVKEILNDEKLIDSIGYVLFLASN<br>EIYWDEIVEIEQLNGEFTIYDLHVPRYHNFIGGNLPTILHNT<br>(SEQ ID NO: 84) |
| Mja RNR-1 | QSLGRDELIFIKEGDKLKVCKIGEAIDEFMEKYKDKIIVDGD<br>TEILYLDGIAEVYTISVNVKTGKAEFKRVYAISRHKPRGKVY<br>KVIGKDGTSIIVTEDHSLFNYDENGNLVCVKPRQMKHIIRNF<br>NNPYDVEYRIGDYIETNYQRTDSKYNSRQNDIPEKLKITKEL<br>CQFLGLFVAEGSYITNGISITTKDDDIAKFIERFVKEQINENIA<br>VKRYEDSVRFVNKGFYRFLKEHINGKAINKNSPEFILKGDK<br>EMKLAFLGGLISGDGYVSKDGRVQIYTTSEQLLGQLHLLLS<br>DLGMIYSITKIKEEGEKIEIKRNEIVRNYKLYVIEIAKNCTEDL<br>KPYVIPKYKKERIKPANYDQLPYDYRIIKEHLRKITDKKPYN<br>DYAWKSNNRKLKLNTLEKIEQLNPHLREEINKFKLNIPFEIK<br>EIKEIDYNGYVYDLSVEDNENFITATGILCHNT (SEQ ID NO:<br>85) |
| Mja RNR-2 | SSLPYDEKILIFENNEYKLVKIGEFVEKYLNRYKDRAITYGD<br>NNIEVYIKDENIYAPSFDKDGKIVLKPITHAIRHRGKEIYEIEL<br>ESGKKVRVTGDHSVFTINDNLDVVEVKASDLKVGDFIITPKI<br>IPSISKDKIYLSEIVKNKDKYYVKIKDHIKFIEEHEEILKESYK<br>EYKTKWKDLKPVLKKKNAFRLDLIEDLVDKEKIEKISYGHA<br>NYINNKIKLDEKFGYLIGAFLSEGHWNDKCVEISSTNKEFIE<br>NLVEIIEEILGKDAYYITVKGDKRRYKDLYVIGLNKTVAMIF<br>ESLGLNKLSSNKEIPSILLSNETFLKGLIKGYIDGDGSIYVDES<br>KRDYSIRLYTTSETLRDTLCLALKILGINYRLSIDKKSKVNEN<br>WRDCYVIKITGKENIEKLLDVEIKNNGGKDVIPKIAEKFKEII<br>NQYSQREWKERFGIDVNNLHIWEDLKKGYMSRYRAKKVL<br>NIMKNVKEIEEKYGRLLDKIGQLIDNDLLFERIKSIRVLDEIP<br>EYVYDISVEGTENFIGGEGFICLHNT (SEQ ID NO: 86) |
| Mja rPol A" | MSLPYEEKIIIKEGEFIKPVEIGKLVDEMIERFGFEKIGNSEVC<br>DLPIDIYALSLDQDEKVHWKRIISCIRHKHNGKLIKIKTKSGR<br>EITATPYHSFVIRKDNKIIPVKGSELKIGDRIPVVKHIPANCVE<br>AINISDYVSGNYVVDNINNKIAPKINGKSIPNNIKLDYDFGYF<br>IGIYLAEGSVTKYFVSISNVDELILNKIRAFADKLGLNYGEY<br>DNNNGFAESHDIRIYSSTLAEFLSNFGTSSNTKKIAEFVFGAN<br>KEFVRGLIRGYFDGDGNVNADRKVIRVTSNSKELIDGIAILL<br>ARFNIFSIKTKTKNQFVLIIPHRYAKKFHEEINFSVEKKKSEL<br>ERLVSSLNDDKTYDSIDMIPSIGDALTKLGEKVDYPKVILKK |

-continued

| 1. Table 1 | |
|---|---|
| | FERKQKIGRATLQRHLRRIEELAVKKGVNILALKEYWLLKK AVESDVIWDEIVKIEEISCDKKYVYDISVEGLETFTTFDGVLT HNT (SEQ ID NO: 87) |
| Mka EF2 | KCVAPETKICLADGRFVRADELFEELKERGRLVKCDESEEV YELREPVGVSSLDKDAVEIVEGKITHVWRLKADKLVEVEV KNGRSIRTTPEHKFLVLDPSGEIVEKRADELEIGDYIVCTQKL VHEGMSEEELKREVFRRLGRDFFVHLPEEEAESVLELAKER GIKALWETLEVDIEENSFYYQLRKGRIRADILVDLAEELGLD LADLYDAVEVSYRSNTKSTKPIRLPEPEDLFYLAGLMFGDG CWNQLTNGSEAIQGEVKRIASDMGLEVRVRRYEGKTARIDF PETVPRILEALFDYPRRKKAHRIRVNDFLTRAPLDCIAEFIRG YFDADGTVEEGRSAVSVTSVSREFLEDLQLLLQKFDVASYL REGDGAYTLYVSGARSLERFPGFREPEKAEKLKKLMEKASS SELEKVPISGEILREVRGDVPTTRMFNCYSNYEGGQVGLTKS SLEKVISTLEAVGVEGEALERLKALARDDVCFLEVVRVEEV EYDGYVYDFTVEEHHNFAAEGFVVHNT (SEQ ID NO: 88) |
| Mvu-M7 Pol-3 | DSVVKDAKVIIKEDGKIKEIKIEDLFKKVDYTIGDKEYCILNN VETLTIEDTKLVWRKVPYIMRHRTNKKIYRVKVKDRYVDIT EDHSIIGVKNNKLVELKPTEIKDDETKLIILNKDLKSYNFASV EEINCIKYSDYVYDIEVENTHRFFANGILVHNT (SEQ ID NO: 89) |
| Pab CDC21-2 | LCVAPETLIITENGTKEIGEVVERWMKELGEIEYDDGISYSPA FEKVASLNGGKVKMLPVRRVWKLRSPGKMIKIRSESGKQIT VTPETKLLTIIDGSLEWVEARKLKKGNYVAVVNKERSIVPIG DFLAKLLKFYGVELNLNEAVERDQARKLLETLKSKGLSDV TIEIPEKLRRFIKCDRVRYVDLVEMLSSMEGELKEEVMLLLS DVGDIHEVIQERLKEIGKILESDASWERIAEVEEVVRDGHVY DLTVEGSHSFIANGFVVHNT (SEQ ID NO: 90) |
| Pab IF2 | KCLLPDEKVVVPSVGFVTLKELFETASKVVERDDEKEIREL DERITSVNGDGKTGLVKASYVWKVRHKGKVIRVKLKNWH GVTVTPEHPFLTTKGWKRADQLRPGDYVAVPRFIHGNEDE KIFLSYVKVKKSGEEWKEYFYLAGRKGNIDVNLLFVAPKR YVVEFLRGYFEERSEVKGESVIVEARELVEPLSLALLRFGIFS KIQGSKLIVTGKRNLEAFKDYIGFKDEREKALEEAIEKVKGS EVYPIFEEIRRLRLLFGFTREELGSYAKYENSEAPTYEELMEI LDFIERGSPSLSKKIAILEGKLKAELRVLEEEGLIKDGKLTPL GRELLEVWRNREFDSKDVDYIRNIAETLVFIPVENVEEEEYD GYVYDLTTETHNFIANGILVHNT (SEQ ID NO: 91) |
| Pab RFC-1 | KCLTGDAKVIANGELTTIGELVERISNGKLGPTPVRGLTVLG IDEDGKLVELPVEYVYKDKTSELVKIRTRLGRELKVTPYHP LLVNRRNGKIEWVKAEELKPGDRLAIPSFLPAMLNDNPLAE WLGYFFGNGYTDSEERVVFESKSKELRKRFMELTRKLFQD AEIKEDSGKVYVSSSEVKRLVKSLNKDSIPEQAWKGLRSFL RAYFDCNAEIKDKIIVSTAGKEIAEQISYALAGLGIVAEVDD KGSVIISDPENVSRFLDEIGFSVEEKKEEAKALIKKSTLNLGI YVDKELISYVREKLKLSFYENETMWSPEKAREIAWKLMKEI YYRLDELERFKKALSKSVIIDWSEVEKKKEEISEKTGISVNEI LEYAKGKRKPSLEEYVKIAKALGVELKETLEAIFTFGKKYL GYVISDEIETLEEVRKEELKRLKELLNDEKLKKGVAYLIFLA QNELLWDEIIEVEKLKGDFVIYDLHVPKYHNFIGGNLPTVLH NT (SEQ ID NO: 92) |
| Pab RIR1-1 | GCIDGNAKIIFENEGEEHLTTMAEMYERYRHLGEFYDENYN RWGIDVSSVPIYVKSFDPETRRVVKGRVRAIWKYELGEEIPK YEIRTHKGTKILTSPWHPFFVLTPDFEVIEKRADELKVGDILI GGMPDGEDHELIFDYWLAGFIAGNGNLDDSEREYKARELL DGIENGIPPKILRKGKNAVLSFITGLFDAEGHVNDKSGIELG MVNKKLIEAVTHYLNSLGIKARMREKRRKNGIDYIMHVEE YSSLLRFYELIGKHLQNNEKKEKLEILLHKHNGGAFDLSLNF NAFKEWASRYGVEFKTNGNQILAIIGNEKVSLGQWHARGH VSKAVLVKMLRKLYEVTKNDEVKEMLHLIESLEVVKEITIT NEPKTFYDLTVDKYQNYLAGENGMIFVHNT (SEQ ID NO: 93) |
| Pab VMA | KCVDGDTLVLTKEFGLIKIKDLYKILDGKGKKTVNGNEEWT ELERPITLYGYKDGKIVEIKATHVYKGFSAGMIEIRTRTGRKI KVTPIHKLFTGRVTKNGLEIREVMAKDLKKGDRIIVAKKID GGERVKLNIRVEQKRGKKIRIPDVLDEKLAEFLGYLIADGTL KPRTVAIYNNDESLLRRANELANELFNIEGKIVKGRTVKALL IHSKALVEFFSKLGVPRNKKARTWKVPKELLISEPEVVKAFI KAYIMCDGYYDENKGEIEIVTASEEAAYGFSYLLAKLGIYAI IREKIIGDKVYYRVVISGESNLEKLGIERVGRGYTSYDIVPVE |

-continued

| 1. Table 1 | |
|---|---|
| | VEELYNALGRPYAELKRAGIEIHNYLSGENMSYEMFRKFAK<br>FVGMEEIAENHLTHVLFDEIVEIRYISEGQEVYDVTTETHNFI<br>GGNMPTLLHNT (SEQ ID NO: 94) |
| Pfu CDC21 | LCVAPDSLVVVNDKVQEIGKLTEEWGREVGFLEYSSGIFYA<br>PYLGRGISLDLVTGKVKPSVVSKVWKLKSPEELVTIKTITGK<br>EITVTPETKLLTFNGTLEWKEAGKIKPGDYVLTVKKLHING<br>KQETLDEKLAYKRGLSLSDPIEFFSSSERTISAYLKGIFDKVG<br>RLVGDTAVIKVDKDMAKRLQILILRLGIVSSVDETGKVIIGR<br>EYIQKILGYNVSVVTHEVELFREFIAEISKFYGTSEEDVYSSL<br>HEKGELDIGTVPVELPEGLREEINRERATYSELVKIAQEIKDE<br>KLYNKLAWILSEVTEEEAKIKEKVNTLKVILSSDIIPERVESV<br>KIIKSPYPYVYDLTVEGSHSFIANGFVVHNT (SEQ ID NO: 95) |
| Pfu IF2 | KCLLPEEKVVLPEIGLVTLRELFELANEVVVKDEEKEVRKL<br>GKMLTGVDERGNVKLLNALYVWRVAHKGEMIRVKVNGW<br>YSVTVTPEHPFLTNRGWVKAGELKEGDYIAIPRRVYGNEDI<br>MKFSKIAKELGIKGDEKEFYLAGASIDIPIKVLFLAPSKLVSA<br>FLRGYFDAKGVVRENYIEVPLFEDLPLLILRFGIVSRIEKSTL<br>KISGKRNLELFRKHVGFTDSEKAKALDELISKAKESERYPIIE<br>ELRRLGLLFGFTRNELRIEENPTYEVIMEILERIERGSPNLAE<br>KIAVLEGRIKEENYLRILEEEGLIENGKLTELGKELLEVWRN<br>REFDSKDVDYVRNIVENLVFLPVEKVERIEYEGYVYDVTTE<br>THNFVANGILVHNT (SEQ ID NO: 96) |
| Pfu RFC | KCLTGDTKVIANGQLFELGELVEKLSGGRFGPTPVKGLKVL<br>GIDEDGKLREFEVQYVYKDRTDRIIKIKTQLGRELKVTPYHP<br>LLVNRENGEIKWIKAEELKPGDKLAIPSFLPLITGENPLAEW<br>LGYFMGSGYAYPSNSVITFTNEDPLIRQRFMELTEKLFPDAK<br>IRERIHADGTPEVYVVSRKAWSLVNSISLTLIPREGWKGIRSF<br>LRAYSDCNGRIESDAIVLSTDNNDMAQQIAYALASFGIIAK<br>MDGEDVIISGSDNIERFLNEIGFSTQSKLKEAQKLIRKTNVRS<br>DGLKINYELISYVKDRLRLNVNDKRNISYRNAKELSWELMK<br>EIYYRLEELERLKKVLSEPILIDWNEVAKKSDEVIEKAKIRAE<br>KLLEYIKGERKPSFKEYIEIAKVLGINVERTIEAMKIFAKRYS<br>SYAEIGRKLGTWNFNVKTILESDTVDNVEILEKIRKIELELIE<br>EILSDGKLKEGIAYLIFLFQNELYWDEITEVKELRGDFIIYDL<br>HVPGYHNFIAGNMPTVVHNT (SEQ ID NO: 97) |
| Pfu VMA | KCVDGDTLILTKEFGLIKIKDLYEKLDGKGRKTVEGNEEWT<br>ELEEPITVYGYKNGKIVEIKATHVYKGASSGMIEIKTRTGRKI<br>KVTPIHKLFTGRVTKDGLVLEEVMAMHIKPGDRIAVVKKID<br>GGEYVKLDTSSVTKIKVPEVLNEELAEFLGYVIGDGTLKPRT<br>VAIYNNDESLLKRANFIAMKLFGVSGKIVQERTVKALLIHSK<br>YLVDFLKKLGIPGNKKARTWKVPKEILLSPPSVVKAFINAYI<br>ACDGYYNKEKGEIEIVTASEEGAYGLTYLLAKLGIYATIRRK<br>TINGREYYRVVISGKANLEKLGVKREARGYTSIDVVPVDVE<br>SIYEALGRPYSELKKEGIEIHNYLSGENMSYETFRKFAKVVG<br>LEEIAENHLQHILFDEVVEVNYISEPQEVYDITTETHNFVGG<br>NMPTLLHNT (SEQ ID NO: 98) |
| Pho IF2 | KCLLPEERVILPDYGPITLEELFNMTKETVFKDEEKEVRKLG<br>IRMPVAGVDGRVRLLEGPYVWKVRYKGKMLRVKLKDWH<br>SVAVTPEHPFLTTRGWVRADQLKPGDYVAVPKILPGKDDK<br>EKFLQYVHEKLKGKVHIKLPSSDEEWETFFYFAGTIFGRENS<br>VNPEGLTHEVKALLELFKVLFEYPREVLRVLFMAPVRYVA<br>NFLRGFFDINGYVNGEELRVEVRGAPHEVLEELSLILLRLGI<br>VSKIYPTSLAISGRRNLELFRRYIGFSEKQKAKELEGIIRRSEN<br>SESYPIFEELRRIRLLFGFTRAELSSTIPLYSKYESKEAPSYEIL<br>MKILNTIEKGSKDLNKKITILEGRVRDHEYIEEFKREGLIKDG<br>KLTELGKELLEVWRNREFDSRDVNYLRNIIENFVFLPVEKIE<br>EFEYDGYVYDVTTETHNFIANGILVHNT (SEQ ID NO: 99) |
| Pho RFC | KCLTGDTKVIANGQLFELRELVEKISGGKFGPTPVKGLKVIG<br>IDEDGKLREFEVQYVYKDKTERLIRIRTRLGRELKVTPYHPL<br>LVNRRNGEIKWVKAEELKPGDKLAVPRFLPIVTGEDPLAEW<br>LGYFLGGGYADSKENLIMFTNEDPLLRQRFMELTEKLFSDA<br>RIREITHENGTSKVYVNSKKALKLVNSLGNAHIPKECWRGI<br>RSFLRAYFDCNGGVKGNAIVLATASKEMSQEIAYALAGFGII<br>SRIQEYRVIISGSDNVKKFLNEIGFINRNKLEKALKLVKKDD<br>PGHDGLEINYELISYVKDRLRLSFFNDKRSWSYREAKEISWE<br>LMKEIYYRLDELEKLKESLSRGILIDWNEVAKRIEEVAEETG<br>IRADELLEYIEGKRKLSFKDYIKIAKVLGIDVEHTIEAMRVFA<br>RKYSSYAEIGRRLGTWNSSVKTILESNAVNVEILERIRKIELE<br>LIEEILSDEKLKEGIAYLIFLSQNELYWDEITKVEELRGEFIIY<br>DLHVPGYHNFIAGNMPTVVHNT (SEQ ID NO: 100) |

-continued

1. Table 1

| | |
|---|---|
| Pho VMA | KCVDGDTLVLTKEFGLIKIKELYEKLDGKGRKIVEGNEEWT ELEKPITVYGYKDGKIVEIKATHVYKGVSSGMVEIRTRTGR KIKVTPIHRLFTGRVTKDGLILKEVMAMHVKPGDRIAVVKK IDGGEYIKLDSSNVGEIKVPEILNEELAEFLGYLMANGTLKS GIIEIYCDDESLLERVNSLSLKLFGVGGRIVQKVDGKALVIQS KPLVDVLRRLGVPEDKKVENWKVPRELLLSPSNVVRAFVN AYIKGKEEVEITLASEEGAYELSYLFAKLGIYVTISKSGEYY KVRVSRRGNLDTIPVEVNGMPKVLPYEDFRKFAKSIGLEEV AENHLQHIIFDEVIDVRYIPEPQEVYDVTTETHNFVGGNMPT LLHNT (SEQ ID NO: 101) |
| Pma-EXH1 GyrA | YCVTGDTLINTDRGLIKIKDIVPDSEENSDNPINIKVQSLNRK INHSDMFFNSGKHKTIKLETEEGYEIEGSFNHPVLTWTTENG KPVYKWKTLDSIRAGDYLVVSRENDIDSDQDLITEEEAVLL GSLVSEGYISENRAGFNNTDEEYASVFENAYKDIYGDTFCR YERTLKSGKTLVEYQIHHKEIIQDIREKEFDKKSSDKEIPFVV LQSSKRVQRAFLKALFEGDGTVYETARAVNISYSSKSKKLL KQLQVLLLNFGIVSRIHRDKQNYRLIISGYQNIKLFKEKVGF LGKKQEKLIKLVEKIYKKETANSKTDFIPFIADYIRDKYRGK GFNEWLSKHSLDRYHKIEKYWDTLSNILDEEDRSLLKELLY NRYYFAKVKTVEETGEKIVYSIRVKSDCHSFVGNGIVNHNT (SEQ ID NO: 102) |
| Pto VMA | KCVTGDTPVLLADGTVMSIEDIYNKSSGTVEYKNENETLIRL DEPLRLYSFYNGHVNESTSNYIYKGKSDSIIKIRTASGREVK VTPVHKLFRFVDDKIIETEARYLNTGDFIASIKRFNNKDENY LSGDESELLGLYASYGSIEDGILIDASIKDRFINLAMNIFKLK TIKIEYRNDRVLIKNDGLKDFIARMISSGIPSEVMRSRACAAS FINGYLYGKLYHDDVIKLHDNEQNILKISYMLTGLGIIHSIRN NLIEIKAENMKILNSMENELIDNNETLLISNNANDDFDLYPD EIESIEILPGPFDVYDVTTPDFGSNFVGGYGAILLHNT (SEQ ID NO: 103) |
| Smar 1471 | ASVSYDTPVLIRDPINKIHLVKIGEFIDKFYEEGEERTAKHVN GYYVLSHDGFQVVWKPIKYVLRHRTNEIYEIIYEGGGKLEA TGSHSVFVLDPDTLDIVEKPVMLLNKGEYLVSFNGVKENKD HQTIDLIDLVSDYNDVYVDNIPSELKKHTGGRNPIPLKQYMI LRKRVITKKNNSLIKLRRSKYTLPIRLVLDEKLAFLFGAYIA NGCVKERRDKLICFTFGKSAKNIADKVMNIMYEKFNIKPFID DRGTYIIYEYPHTLLAIIFEKLLGRKLEEKKMPEILWSSPKSVI RAFFEGLRAYSQRTLRRRYTSYTTANKNLAYQLLWLARFA GFYSVLKEEKEAGKNNGKTYYHVIVYLDQSYRKPNASERV PVKPILKLIKYTKPRTMPPELAYIKRREFISRKTALKALEWIR RDGSFTDFSREYLRKIESLINGDIIVLKIKDVRKKQYKGYVY DISVPITEAFFGGNIPILLHNT (SEQ ID NO: 104) |
| Smar MCM2 | QSYHKDFKIMLADGRKVRIGDLVDELIGKNREKVIKGKDTE ILFVDDLFLLSYNMRSGEQVLVKADRVSRHKAPDQFIKLRF SNGAEIIVTPEHPVLIINNGKIKTVRADTVRKGTLTIGVLGHK IIKEVNEDDIINNIRRKIVLDKELPYIHAKNISEAVEMRDQLM SIDIPTFIVKHKNEIRLYPSGPCSLRRLLLMHGVEEVVFSDEL LYEIMNCHLYPATWYELLYSMGLTKIAKELNVYDFEILAGII KKVEKEVIMLSQVLGLRNETQTELLHLKSRRELLIRLKDKL DMLRKRLKDLEEALGKDA VIRMITDVEVIKNTDSDWVYDIT IEPYHLFVSDGLILHNT (SEQ ID NO: 105) |
| Susp-NBC371 DnaB intein | KCLGKGTNVLMYDGTLKKVEDVKVGDQLMGDDSTPRNVL SLARGREEMYWVRQNKGIDYRVNKSHILSLKRSRNENGHH HGDVLNIEVSEYITKSDKFKSNYKGYKVAVDFPEKVLEVEP YFLGLWLGDGRSSDVRIATEDDEVVEYLQAYAFRLDKKVH RYAADGKCTMYGITSIQKEGALKDVSDSLQGKLRVLGVID NKHIPRSYLTGSTKQRLELLAGLIDSDGYYDDAYHVMEIVQ KRKELAEQIKFLADSLGFRSSLVKKKASIKAIGYESEVYRVR IVGHLNIIPTKVVRKQVRALMSKREHMHTGIKVEYDKVDD YYGFVLDGNHLFLLEDMTVTHNT (SEQ ID NO: 106) |
| Tac-DSM1728 VMA | KCVSGDTPVLLDAGERRIGDLFMEAIQDQKNAVEIGQNEEI VRLHDPLRIYSMVGSEIVESVSHAIYHGKSNAIVTVRTENGR EVRVTPVHKLFVKIGNSVIERPASEVNEGDEIACASVSENGD SQTVTTTLVLTFDRVVSKEMHSGVFDVYDLMVPDYGYNFI GGNGLIVLHNT (SEQ ID NO: 107) |
| Tag Pol-3 (alternative name: Tsp-TY Pol-3) | DSVTGDTEIIVKRNGRIEFVPIEKLFERVDYRIGEKEYCILED VEALTLDNRGKLIWKKVPYVMRHRAKKKVYRIWITNSWYI DVTEDHSLIVAEDGLKEARPMEIEGKSLIATKDDLSGVEYIK PHAIEEISYNGYVYDIEVEGTHRFFANGILVHNT (SEQ ID NO: 108) |

-continued

| 1. Table 1 | |
|---|---|
| Tfus RecA-1 | KCLTADTYVWTDRGLETVAEVFGRAGLPLSSTSRVTDVRD<br>RDIRVVNEKGELEQVAALTHNGRQPVVRITVASGRQVTVT<br>RNHPLRVMNDDGFIVWREAGQLREGDVLVSAAFGAVQAA<br>SGGGLSEDEAVLLGYLTAAGSLDPAGHVCFTTTDIETGAEF<br>AALAEWLLDTTVTAVPGDGQVAYVLSDPAARHTLAERYG<br>VDYAAAARIPQCVRTAGDKMQRAFLAALYTAAGWTDTSA<br>AVGLRTASAPLAREVQYLLYGLGIPADLDRSHGNGQHPWA<br>VTISPAAAPRFHTEVGFRTAQQSPQTGLHEPTPQVEAIPNLT<br>GLIHALRDSIGDRAESTDDPFPAASGGAYDRDQVRRVIDWA<br>KRRTDEAPATANAILGYLTQLTDARYTYEPITAVEDAGQQP<br>TFDLMVPRTHSFLANGILSHNT (SEQ ID NO: 109) |
| Thy Pol-2 | DSVTGETEIIIKRNGKVEFVAIEELFQRVDYRIGEKEYCVLEG<br>VEALTLDNRGRLVWKSVPYVMRHRTNKRIYRVWFTNSWY<br>LDVTEDHSLIGYMNTSKVKPGKPLKERLVEVKPGELGESVK<br>SLITPNRAIAHGIRVNPIAVKLWELIGLLVGDGNWGGQSNW<br>AKYNVGLSLGLDKEEIEEKILKPLKNTGIISNYYDKSKKGDV<br>SILSKWLARFMVRYFKDESGSKRIPEFMFNLPREYIEAFLRG<br>LFSADGTVSLRKGVPEVRLTSVNPELSSSVRKLLWLVGVSN<br>SMFVETNPNRYLGKESGTHSVHVRIKDKHRFAERIGFLLDR<br>KATKLSENLGGHTSKKRAYKYDFDLVYPKKVEEIAYDGYV<br>YDIEVEGTHRFFANGILVHNT (SEQ ID NO: 110) |
| Tko CDC21-2 | QSYHHDFELLLADGRKVKIGELVDKLIEKNRDRVILGKDTEI<br>LPVEDIELLAYDLEKREIVKVKADRVSRHKAPERFIKLRFSN<br>GREITVTPEHPVMVWENGEITEKPAEKITPGDIALGVLRYPI<br>QVDGKFKERYRDMREAEDYQDYLYSRGVVSKIKRTGIYFT<br>VEKARRALPRELVKPLINAGKILRVTQTPKERASFNQKLVR<br>ENIIEGYLQRIIERMDELERLSREDPAKALELLPKTQLYYKY<br>GITYGKLKKLAEARNSWAEGIIQSAVAERISLAKRELEEFFK<br>WWNANVNFLKVKCVEEIKNDRWEWVYDVTVEPHHLFVSH<br>GLVLHNT (SEQ ID NO: 111) |
| Tko IF2 | KCLLPDEKVILPEHGPITLKGLFDLAKETVVADNEKEIRKLG<br>AKLTIVGEDGRLRVLESPYVWKVRHRGKMLRVKLKNWHS<br>VSVTPEHPFLTTRGWVRADQLKPGDYVAVPRVIHGNESDE<br>RFVSFVYEKLKNDELIAKLRGEVLSKISSEFKGDRAYKVER<br>NVFRWEDIERLNLWDEVERVAFTPRMHRSGKPLHYVKLPR<br>SPEEWEAFFYFAGVMFGDGSQDKIANNDVEVYEELKKLSV<br>LGVAVKRVERTTSYEIELTNGKNALLRLLRVLFEYPERQKA<br>KSIRVPRILFIAPRKYVSRFLRGYFDADGHVSLKDARIEVTSA<br>SQEFLEDLSLLLLRFGIVSKIYRSDYTTLVISGRRNLDLFRRYI<br>GFSVKNKAEALEKAIKKSRRSESYPIFEELKRLRLLFGFTRTE<br>LNSNVPFYGKYESEEAPSYETLMRILDAIEKGSINLDKKIAV<br>LEGRIRDHNYIKAFEKDGLIKDGKLTELGRELLEVWRNREF<br>DSSDVDYIRNLAENLVFIPVEDIEEFEYEGYVYDVTTETHNF<br>VANGILVHNT (SEQ ID NO: 112) |
| Tko RadA | KCFAKDTKVYYENDTLVHFESIEDMYHKYASLGREVPFDN<br>GYAVPLETVSVYTFDPKTGEVKRTKASYIYREKVEKLAEIR<br>LSNGYLLRITLLHPVLVFRNGLQWVPAGMIKPGDLIVGIRSV<br>PANAATIEESEAYFLGLFVAEGTSNPLSITTGSEELKDFIVSFI<br>EDHDGYTPTVEVRRGLYRILFRKKTAEWLGELATSNASTKV<br>VPERVLNAGESAIAAFLAGYLDGDGYLTESIVELVTKSREL<br>ADGLVFLLKRLGITPRISQKTIEGSVYYRIYITGEDRKTFEKV<br>LEKSRIKPGEMNEGGVGRYPPALGKFLGKLYSEFRLPKRDN<br>ETAYHILTRSRNVWFTEKTLSRIEEYFREALEKLSEARKALE<br>MGDKPELPFPWTAITKYGFTDRQVANYRTRGLPKRPELKEK<br>VVSALLKEIERLEGVAKLALETIELARRLEFHEVSSVEVVDY<br>NDWVYDLVIPETHNFIAPNGLVLHNT (SEQ ID NO: 113) |
| Tko RFC | KCLTGDAKVIANGRLFELGELVEKVSKGRFGPTPVEGLKVL<br>GIDEDGKLREFEVQYVYKDRAERLIKVRTRLGRELKVTPYH<br>PLLVNRKNGEIMWVKAEELRPGDRLAVPRFLPAIAEEDPLA<br>EWLGYFIGDGHADSKNKVITFTNTDPSLRQRFMELTERLFP<br>DAKIRERIHKNRAPDVYVNSRRAWELVSSLGLAGRKADKV<br>YIPEKGWEGIRSFLRAYFDCDCGVDKNAVVLATASREMAE<br>QVTYALAGFGITSKIREKKVRGKTYYHVTISGSENLERFLSEI<br>GFSHREKLERTLKLVKKPNPNLDSLNVNYELISYVRDRLKL<br>NFSDDKRSWSHRKARKISWELMKEIYYRLDELERLKESLSR<br>SILIDWNEMAERRKEIAEKTGIRADRLLEYIKGKRKPSLRNY<br>IKIAKALGIDLEPTINAMRVFARKYSSYAEIGRKLGTWNSSV<br>RIILESNTEKIKELEEIRKIELELIGEILSDEKLKEGVAYLIFLS<br>QNELYWDEITEVKELKGDFVIYDLHVPGYHNFIAGNMPTV<br>VHNT (SEQ ID NO: 114) |

-continued

1. Table 1

| | |
|---|---|
| Tko RIR1-1 | GCIDGNAKIIFENDGEEHIMTMAEMYERYKDLGEFYDPEYN<br>RWGINVEEVPVYVKSFDPSTKEITKGKVKVIWKYELGEDVP<br>KYEIKTNKGTRVLTSPWHPFFVITQDLKIVEKRADELREGD<br>MLVGGMPSDDDYEFLLDYWLAGFIAGDGSIDKYRSHVKGH<br>EYVYDRLRIYDYTTETLGIINDHLEKTFGKRYSLQRDRNIHY<br>IDIKAKGITSHYIELLRGITNGIPQPILKEGRNAVLSFITGLFD<br>AEGHVNSKPGVELGMVNRKLIEDITYYLNSLGIKARMRKKP<br>RKDGVDYVMHVEEYSSLLRFYELIGKNLQNSEKRIKLEELL<br>SKHNGGSFGLTLSFEDFKAWSSKYGVEFKTNGSQTLAIIKNE<br>KVSLGQWHRRGRVSKAVLVKMLRKLYDTTKSEDVKRMLH<br>LIEGLEVVKEINVTNEPKTFYDLTVERYQNYLAGENGMVFV<br>HNT (SEQ ID NO: 115) |
| Tli Pol-2 | DSVSGESEIIIRQNGKIRFVKIKDLFSKVDYSIGEKEYCILEGV<br>EALTLDDDGKLVWKPVPYVMRHRANKRMFRIWLTNSWYI<br>DVTEDHSLIGYLNTSKTKTAKKIGERLKEVKPFELGKAVKS<br>LICPNAPLKDENTKTSEIAVKFWELVGLIVGDGNWGGDSR<br>WAEYYLGLSTGKDAEEIKQKLLEPLKTYGVISNYYPKNEKG<br>DFNILAKSLVKFMKRHFKDEKGRRKIPEFMYELPVTYIEAFL<br>RGLFSADGTVTIRKGVPEIRLTNIDADFLREVRKLLWIVGISN<br>SIFAETTPNRYNGVSTGTYSKHLRIKNKWRFAERIGFLIERK<br>QKRLLEHLKSARVKRNTIDFGFDLVHVKKVEEIPYEGYVYD<br>IEVEETHRFFANNILVHNT (SEQ ID NO: 116) |
| Tli RFC-1 | KCLTGDVKVIANGRLCELGELVEKVSNGRFGPTPVKGLKVL<br>GIDEDGKLREFEVQYVYKDRAERLIRIRTRLGRELKVTPYHP<br>LLVNRKNGEIKWVKAEELKPGDKLAVPRFLPAIAEEDPLAE<br>WLGYFIGDGHADSRSNVITFTNADPSLRRRFMELTERLFPD<br>AKIKERIHKNRAPDVYVNSRKAWELVSALGFAGRKADKVY<br>IPEKGWEGIRSFLRAYFDCDAGVDKNAIVLATASREMAEQV<br>TYGLAGFGIISKIREKKVRGKLYYHVTISGSENVERFLSEIGF<br>SHREKLEKAKKLVKKFNPNLDSLKVNYELISYVRDRLKLNF<br>SDDKRSWSHRKAREISWELMKEIYYRLDELERLKESLSRSIL<br>IDWNEVAERRKEIAEKTGIRVDRLLEYIKGKRKPSLRNYLKI<br>AKALGIDLEPTIDAMRVFARKYSSYAEIGRKLGTWNSSVRII<br>LESNTEKIEKLEEIRKIELELIGEILSDEKLKEGVAYLIFLSQN<br>ELYWDEITEVKELKGDFVIYDLHVPGYHNFAGNMPTVVHN<br>T (SEQ ID NO: 117) |
| Tli VMA | KCVDGNTLVLTEEFGLVKIKELYEKLDGKGRKTVEGNEEW<br>TELETPVTVYGYRNGRIVGIKATHIYKGISSGMIEIRTRTGRK<br>IKVTPIHKLFTGRVTKDGLALEEVMAMHIKPGDRIAVVKKI<br>DGGEYVKLTTSPDFRKSRKIKVPEVLDEDLAEFLGYLIADGT<br>LKPRTVAIYNNDESLLKRANFLSTKLFGINGKIVQERTVKAL<br>LIHSKPLVDFFRKLGIPESKKARNWKVPRELLLSPPSVVKAFI<br>NAYIVCDGYYHERKGEIEITTASEEGAYGLSYLLAKLGIYAT<br>FRKKQIKGKEYYRIAISGKTNLEKLGIKRETRGYTNIDIVPVE<br>VESIYNALGRPYSELKGEGIEIHNYLNGENMTYETFRKFAKL<br>VGLEEVAENHLKHILFDEVVEVKYIPEPQEVYDITTETHNFV<br>GGNMPTLLHNT (SEQ ID NO: 118) |
| Tpe Pol | DSVTGDSEVIIRRNGRIEFIPIEKLFERVDYTVGEKEYHVLSS<br>NVEALTLDDNGKLTWRKVPYVMRHKTEKKIYRVWLTNSW<br>YLDVTEDHSLIGYLNTSRVRAGKPLKDRLCEVKPLELGKSV<br>KSLITPRAPLSRGIKPNEIALKFWELVGLLVGDGNWGGTSN<br>WAKYYVGLACGEDKEEIAEKVLDPLKRAGVISNYYDKSKK<br>GDVSILSKGLAKLMVRYFKDEDGNKKIPEFMFNLPKEYLEA<br>FLRGLFSADGTVSVKRGVPEVRLTTISDRLASDVRKLLWLV<br>GISNSIFREQNPNRYNGKSSGTYSKHVRIKDKLQFAQRIRFII<br>NRKQEKLIKNLKESQYKRTTFKYEFDITPVKKVEEVTYNGY<br>VYDIEVEGTHRFFANGILVHNT (SEQ ID NO: 119) |
| Tsi-MM739 Pol-2 | DSVTSDTEIIVKRNGRVEFVPIEKLFERVDYRLGEKEYCILES<br>VEALTLDNRGRLVWKKVPYVMRHKAKKKVYRIWITNSWY<br>IDVTEDHSLIVAEDGLKEAKPIEIEGKSLIATKDDLSGVEYIK<br>PRTLEEIPYDGYVYDIEVEETHRFFANGILVHNT (SEQ ID<br>NO: 120) |
| Tsp-AM4 RIR1 | GCIDGNAKILFENEGEEHLTTMAEMYERYKHLGEFYDKNY<br>NRWGIDVSSVPIYVKSFDPETGEVVRGRVKAIWRYELGEKV<br>TKYNIKTNKGTRILTSPWHPFFVLNPDFKVVEKRADELSEG<br>DMLVGGMPEDDNHEFIFDYWLAGFIAGDGSFDKQRSHVKG<br>HEYIYDRLRIYDYRVETFETINKYLEETFGKRYSLQRDRNIY<br>YIDIKAREITSHYRKLLDGIDTGIPPEILRKGRAAVLSFITGLF<br>DAEGHVNSKPGVELGMVNRKLIEDIAHYLSSLGIKARMREK<br>PRKDGVDYIVHVEEYSSLLRFYELIGKNLQNEEKRKKLETL<br>LEKHKGGTFGLSLNFEAFKRWASKHGVEFKINGSQTLAIIK |

-continued

| 1. Table 1 | |
|---|---|
| | GEKISLGQWHTRGRVSKAVLVKMLRKLYDATGVEDVKRM LHLVEGLEVVKEITTTNEPKTFYDLTVENYQNYLAGENGM VFVHNT (SEQ ID NO: 121) |
| Tsp-GE8 Pol-2 | DSVAGNTEVIIRRNGKVEFVPIEKLFQRVDYRIGEKEYCALE GVEALTLDNRGRLVWRKVPYIMRHKTNKKIYRVWFTNSW YLDVTEDHSLIGYLNTSKVKSEKPLKERLVEVKPRELGEKV KSLITLNRAIARSIKANPIAVRLWELIGLLVGDGNWGGHSK WAKYYVGLSCGLDKAEIEEKVLRPLKEAGIISNYYGKSKKG DVSILSKWLAGFMVKYFKDENGNKRIPSFMFNLPREYIEAF LRGLFSADGTVSLRRGIPEIRLTSVNRELSNEVRKLLWLVGV SNSMFTETTPNKYLGNESGTRSIHVRIKNKHRFAKRIGFLLD RKATKLSDNLREHTNKKMAYRYDFDLVYPKKIEEINYDRY VYDIEVEGTHRFFANGILVHNT (SEQ ID NO: 122) |
| Tsp-GT Pol-2 | DSVTGETEIIIKRNGKVEFVAIEELFQRVDYRIGEKEYCVLEG VEALTLDNRGRLVWKSVPYVMRHRTNKRIYRVWFTNSWY LDVTEDHSLIGYMNTSKVKPGKPLKERLVEVKPGELGESVK SLITPNRAIAHGIRVNPIAVKLWELIGLLVGDGNWGGQSNW AKYYVGLSLGLDKEEIEEKILKPLKNTGIISNYYDRSKKGDV SILSKWLARFMVRYFKDESGSKRIPEFMFNLPREYIEAFLRG LFSADGTVSLRKGVPEVRLTSVNPELSSSVRKLLWLVGVSN SMFVETNPNRYLGKESGTHSVHVRIKDKHRFAERIGFLLDR KATKLSENLGGHTSKKRAYKYDFDLVYPKKVEEIAYDGYV YDIEVEGTHRFFANGILVHNT (SEQ ID NO: 123) |
| Tth-HB27 RIR1-1 | GCLHPDTLVHTDRGTLRLRELVDPFRRGWQPHTLSVATDE GWRPSPEGYNNGVAPTLRVVLENGLEVQGTLNHKLKVLRE DGTREWVELQDLRPGDWVIWVLDEHTGTPVQLAPLDEPLH PNTTPIRTPEVLTEDLAFLLGFFFGEGFVSGDRIGFSVHEEEP MREEAKRLFRELFGLELREERKPGDRSVTLVVRSRPLVTWL RKNGLLKGKARELEVPRAIRQSPRPVLAAFLRGLFEADGTIT AGYPMLTTASKRLAQDVMVLLGGLGIPSKLLRYNPLPGRFS KAEHYGVRVVTAKGLERYLERIGVPKGSRLEALHGIKPDVR RESSWPLPHAEGLLKPLLTVTEKGRKGYASPYTPLRKDLLR YLRGERQLTATGYAMVLEKAQDLGLEAEPFPFNEYYVRVA SVEPGGEILTLDLSVEGNHTYLANGLVSHNT (SEQ ID NO: 124) |
| Tth-HB8 RIR1-1 | GCLHPDTLVHTDRGTLRLRELVDPFRRGWQPHTLSVATDE GWRPSPEGYNNGVAPTLRVVLENGLEVQGTLNHKLKVLRE DGTREWVELQDLRPGDWVIWVLDEHTGTPVQLAPLDEPLH PNTTPIRTPEVLTEDLAFLLGFFFGEGFVSGDRIGFSVHEEEP MREEAKRLFRELFGLELREERKPGDRSVTLVVRSRPLVTWL RKNGLLKGKARELEVPRAIRQSPRPVLAAFLRGLFEADGTIT AGYPMLTTASKRLAQDVMVLLGGLGIPSKLLRYNPLPGRFS KAEHYRVRVVTAKGLERYLERIGVPKGSRLEALHGIKPDIR RESSWPLPHAEGLLKPLLTVTEKGRKGYASPYTPLRKDLLR YLRGERQLTATGYAMVLEKAQDLGLEAEPFPFNEYYVRVA SVEPGGEILTLDLSVEGNHTYLANGLVSHNT (SEQ ID NO: 125) |
| Tye RNR-2 | QCLSEDTEILTLDGWKRYNEVEIGDSIYTFNINNGEIETKLVT YVFRKEYSGIMYNLKNRSQSQLISPNHRVVRKVFNTEKYRL DRIEDLLSYSSPLIIPVAGENKNPDYPISDEELKIFSWILSEGSI EREGSHRVSIYQSKETHPENYEEIIQLLEDLNFEYSVKEQHSL GKCKHIRLKPKSSKAIHELIGAKVKKFPEYLYRLSKRQARLF LETYLKGDGWTEKFRKRITVTEEEAKDFITAIAVLAGYNFN VRKRKMGGISKKLQYIITLTETKADHIMKIEKIEYRGIIWSVN TENETVIARRNGQVFITGNT (SEQ ID NO: 126) |
| Unc-ERS RNR | ESLPGDEKILIKSGNEISVKQIGEIVDRVLKNAGKEGKIYLDG RSEIVFNEEYDVKAFSFNDDFTVSEVPITQFIRNEPADIYEVN TTYGKKVRVTAGHNFFCLKNRVVCCKPLSELEVGEAILMPR RIQRVAEATFLSGYKNFVQNLTLEEMTDLFILGDPLRDLVRE NEKMIRGRDKNNETKNYRKCVEKCGLPLDILCRTNYMPSL AELKQLRIVSWHGFEDTPEIPLYYEFTPELGEWLGLLLSEGC YSEPNKISFSNNDDLLHARFAELSKGIFGINIMPRRENNSSIIS KSVIPIKAIFSLHGTRSNKSVPDFMYDAPKGCIEGFIRGYHAG DGKKSEMKMTTISEGILRFLRYAFLILGVVPSVYVSNRSNPK WSTSYDVGINSITKFYDLAKGGIGNYNYECGELIITIINEIGG VTGGKESVQLWGYGNARRGKSVSRGTIERFINDAKMRIDN NAEYVIMKEYGKSPFTPKNISELLNVSTKAAYEYVKRLCGR GLCKKVEKSTKYEHSIDYNYSLTDKIFKKYEKVFKSLKILSK LINGDVAFCKIKEIKKVGREETYDIATDTSTQNFIAGDGFLF VHNT (SEQ ID NO: 127) |

Other suitable inteins are provided in Table 2 below. An intein used in the fusion proteins described herein may comprise an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity) with an amino acid sequence provided in Table 2 (e.g. one of SEQ ID NO: 128-190). The inteins in Table 2 satisfy the following criteria: 1) is from thermophilic organisms, and 2) the +1 position of extein is serine (+1S-intein). −1 and +1 extein residues are included for all of the sequences below.

2. Table 2

| | |
|---|---|
| Ape APE0745 | QSLPPWEPIVVRRGDEVRVTSIGEFVDSFLEGEGGLDIGGLG YYTLSLDTRTLKPVWRRIRGVIKHRIRGRLLRVKASKGRSID LTGSHSIYRISRGGGLEVVGSSDLRPGDSLVTPASVELPESAP SSINAARELWSRGVEGIFVVGLPGEAAGYRGVERSRGYDGG HAIPLETLVERYGDSVWSLVSGAKLAVSRGAAGDHPVPATI PLDTGFYLLLGFIVSAGSVDVEGGHVTVTLGPGREGYVGDV VEAVNSTAPGAGVRISSGARGMEVTIRSRVLSELLARVFGA GPGPNRDIPSIVFRAPKPMKRVFLKGLYAGGGVFDRSSGSLI YATDSRSLLNGLALLLLNVGAGGYRIDSGDSGRALALIVEN AGRLDAIGEVLEHLGFHGGREAVQGVGALERATAGLAGQA TVAVQRPATRGGPGVDVAGVTGLEHLEASTEFVYDLSVEG DENFFAGLGWILVHNS (SEQ ID NO: 128) |
| Cau SpoVR | ACLHGDSLIVTDHGLVPMREVVNHRQRLQVSDGERQQTVY DWNRFADYPTVTMRTRAGFTLTGSHNHRIMLADGTWRRL DELQIGDRVRIAGGTELWATEPALLRCRRPLPRVLVTAGAP AATTSSPHRRGYRRAAAVVVDEKLAAAIGRRCVTHADQQA LDAIRRSPRPQVVAFLRAFCQGAGQSVASGLTLTCADADLA TTVQLLLTNLGVLAHRTDTTVRIDNGDDLERAYTTLATPTG WTDEVVALEHGTADVYDISVTATHRYAAQGFINHNS (SEQ ID NO: 129) |
| Cth-ATCC27405 TerA | KQLALDTPIPTPDGWTTMGEIKAGDKVIDEKGRPCNVVAIS EIDDTEQAYKINFRDGTSIVAGERHLWKVQVTNNGRREKLL TTGEMYQKQFKTKSKENRALFRIPIADAFILPENKLPIDPYLF GYWIGNGNAVKPEITVMRDDVDEVIKNIPYKLHNRYKQEG NSDILVYKELKSILVKNFREKRIPIEYLRASAQQRKRLLQGLI DSDGCVSTAKSQAIYVTILFELAKDVQDLLWSLGIKNTLKT APSARYGIETGEICYLIKFTAFNDLEVSGLDRKLKRGRERNI KTRSHFHYIKSIEKTGKTKMRCIQVDSPSRLYLAGKSMIPTH NS (SEQ ID NO: 130) |
| Cth-DSM2360 TerA | KQLALDTPIPTPDGWKRMGELKQGDVVFDENGSPCHVLAL SEIDDTEQAYRLTFGDGSSIIAGARHLWKVQIINNGRKERLL QTQQMYEAFSAYRKRHKDAPFRSIYRIPVAGALKLPDAKLP VDPYLYGYWLGNGCATRPEITIRTCDVAGVLKRIPYEVSSL WKNVGDSVVVRIPVLKSVLLKSHHSKHIPSEYLRASENQRW ELLQGLMDSDGCIGKLKAQSIYVSTEKQLALDVRELLWSLG IKNSMTESPSQRCGKPTGKTLYTIRFTSFADLPTSGLARKLC RRKETGSSPTRSNYHYIHSIEPVKERIPMRCIQVSSPSRQYLA GTSMVPTHNS (SEQ ID NO: 131) |
| Hut MCM-2 | AAVDELDKMRCVTGDTLVQAGDGRRRIRELAGETAEAGSI EELPNGRTIRDVDIDVWTMTDDETLTRRPVTAIHEYDAPETL YEVTLSTGEEVTVTPDHPFFIEQASGRVETPAEDLQPGDLVF VPEGSAMATDGGIAQIDTSSDRLGPAESGLGDIGLRTIENVE SVPDHDYDSVYDLTVEGTHNFLANGMVVHNS (SEQ ID NO: 132) |
| Hut-DSM12940 MCM-1 | KCLDADTNVQLADGTTSAIGELVEANLDDPKPVDDGVWD HASIPLPTLAPDGSLTTAEATKVWKREAPEHLYRIRTESGKE LDVTPSHPLFVQQDGTPTAMEAENLEEGEFVATPRSVPTAG DDRIEADHRESQSPNAVRFSAPDTWTPSLARLVGYIVAEGH VVHRADNTADLRITNEDEPVLEDARAAFEALDLPYSEDVRE ESGVTRLRCHSSEFVSFLEAIEPAILENSAYQRVPERIKQASD SIRRAFLRAYVEGEGHVAASERELTVASMSEALLEDVRCLL TTLGIDASIHERVNGSYRLRISGDDFGHYVSAVGFVTDRKQ LAAESYEGTAGNTNRDVVPVSGDTLREVREALALTQTDCG VPRTTYQHYERGDRNPSRGSLRAVVDAFEKRLAWLKDQRE GLAAEDWETIVELRDELSISQQSLADGMDVTQTAISYYERN EVAPDGGETVAASSVINDRLEEALAVESTVDRLDDLATNDV RWDRIASIEAVEPDDEWVYDLEVEGTHSYVSNGVVSHNS (SEQ ID NO: 133) |
| Mein-ME RFC | ASVSKDTPILVKINGEVKRTTFAELDKLYFNERDGDISYKDT PNLEVLTVDDNYNVRWAKVSKIIRHRVEKILRVHLEGGGVL ELTGNHSIMLLGENGLVAKKASEIKVGDYFLSFVTEMPGLL DKISLNNYQLRRESARTKVFDELYINEDLAWAFGLYTAEEF REDTSGQVIYTLGSHELPLIERIKTIAQELDLSIYENFTSSGFD |

-continued

| 2. Table 2 | |
|---|---|
| | RSRFSAKQVRILNTQLAKFIKENFYDGSGERAVNKRVPSFM<br>YEAPIQDRISYLKGLADGDIWDKVIRISSVSKDLLIDIAWLSR<br>ISGIESSIFDQEVRLIWKGGMKWKKSDLVPADIVISLLKKLE<br>NKINGNWRYELRHQLYDGKKRVSKDIIKKILKMIEVEELKE<br>DERKILSLLRKLAYSDLHAVKVTKIEVIEYNDFVYDVSVPN<br>NEMFFAGDIPILLHNS (SEQ ID NO: 134) |
| Mesp-FS406 PolB-1 | RCHPKGTKVVVKGRGIVNIEEVKEGDCILGIDGWQRVKKV<br>WEYDYEGELINVNGLKCTPNHKIPLKYDYLIRDIYAKSLLN<br>KFKGEGKLIRCKDFELIGNYEKYINDIDEDFILKSELIGILLAE<br>GHLLRKDIEYFDSSRGKKRISHQYRVEITVNEDEKDFIERIKY<br>IFKKLFNYELYEKRRKNSKAITLGCAKKDIYLEIEEIMKNKE<br>KYLPNAILRGFFEGDGYVNTVRKTIVVNQGTNNYEKIKFIAS<br>LLDKLGIRYSFYEYNYEERGKKLKRYIIEIFSRGDLIKYSVLV<br>GFISKRKTDLLNEIIRQKTLYKLGDYGFYDLDDVCVSVEHY<br>KGKVYDLTLEGRPYYFANGILTHNS (SEQ ID NO: 135) |
| Mesp-FS406 PolB-2 | NSILPDEYLTVIEEDGVKIIKIGDYIDDLMRKHKDKIKYDGLS<br>EILEVDNLKTYSFNRKTKKCSINRVKALIRHPYSGKAYKIKL<br>RSGRTIKVTEDHSLFKFEKGRPVCVRGDEIQPGDLIVVPRKL<br>KFVNKKDVIINIPKRLVDADEEELKDLTITKHKDKEFLVRLR<br>KTLEDIKNNKLKIIFDDCISYLENLGLIDYSIIKKINKIDIKILD<br>EEKFDAYKKYIDTFVEYGTFRKDRCNIQYIRIKDYIPNIPDKE<br>FEDCEIGAYSGKINALLKLDEKLAKFLGYFVTRGRLKKLKIK<br>GETVYEISVYKSLPEYQKEIAEVFKEAFGAGSIAKDKVTMD<br>NKIIYLVLKYIFKCGNRDKKHIPEEIFLANENIIKSFLEGFLKA<br>KKNSHKGTTTFMAKDEKYLHQLILLFSLVGIPTRFTPVKNK<br>GYKLTLNPNYTIVEDLMLDEVKEVEAFDYTGYVYDLSVEK<br>YENFLINNIYAHNS (SEQ ID NO: 136) |
| Mesp-FS406 PolB-3 | NSILPNQWMPIVEDNDIKFVKIDNYINQLMDRNKYKIKFDG<br>NSEILEVDNLKAFSFNRQSKKCEIKRVKALIRHKYSGKAYKI<br>KLRSGREIEVTMGHSLFKYENGKIVEVKGEDVKVDDLIVVP<br>KSIVAIEEDITINIPKVLAKLDDDSLILEIPKEKRNEIKKKISTI<br>KDKSLRKFYELILKHSKYTKNGNYIIKLSKVKDIIDYIPDKEF<br>INFKIGTRGGKRINAIIKLDEDVAKFLGYYVSEGYARCSKNQ<br>KNGYSYEIYIANHDKDILKDMERVTTKIFDKCKVCKDRVRV<br>MSKIAYLFVNYVVPCGIKAENKQIPEIIFKAKKSIKLAFLEGY<br>FIGDGDIHPSKRLRLSTKSEKLAYQLMFLLNSLGISAVKIGFD<br>SGVYRVYINEDLPFITTNRKRNKYYSNVIPKEILEYIFNKKFQ<br>NNMSIDKFKEFIKDKDINGFEWLLNGDITFDRVKEIEEFDYN<br>GYVYDLSVEDNENFLINNIYAHNS (SEQ ID NO: 137) |
| Mesp-FS406-22 LHR | VCVSPDTKILTNNGLIEIKDLKSNNKILGIDNFKGKFTEFDKP<br>HIRDYNNDGFLIKTNLGFEIKCTKEHRFLTIANGELKWVESR<br>TLKVGDYIAVLRKYPNDGEKINILDLLPDNAYVGLKKSTLE<br>KIRMKIKEKYGTSKNFSKIIGMEKSHFNAKLRGESPFKLKVL<br>REIEKILSIKIESEDIEIIRTNKKKYPMEIKTFTPFLARLLGFW<br>MADGSWTSGCLRLFSSDLQLLKEYEKRIIEELNMKPHYRRA<br>NKSTYCLEISSSVLETMFKNLVGNKKRKSKNGMFPEILYKL<br>PLEHKKAFLSGYFDGDGFLEIKKDNKLYSIGFSTFNKRFAEG<br>IRDLLLYFGIMSSVRKQEINYENELNGRIIKKRGVSYTVSILG<br>GEYLEKAINILDIWRTKDRELIKKAFSAGYCNIDIIPNIGKKL<br>REIREKLRISTYKLQKEKFYNPQRVEVGERQISRRNLIKLMN<br>KYLDYAKKTNNKEVIEEIESLLRLAEGDIFFDRIKEIKSIKLK<br>KVYGIINSKTGNYIVNNFISKNS (SEQ ID NO: 138) |
| Mfe-AG86 Pol-1 | NSILPDEYLVVIEDDKVKVTKIGEYVDNLIEKNKEKVKYEK<br>KSEILEVDNLKTYAFSKIDKKCRIRKVKALIRHPYSGKAYKI<br>KLRSGRSIKVTKGHGLFKYENGKIVAVKGDEIKIKDLIVVPR<br>KIPYINKEVIINIPKGLIDADEEEINDLTITKHKDKEFLVKLKK<br>TIEDIEKNKLNVVFEDCLKYLEDLGLIRYEGIKRINKLEIDIPN<br>KRKLSIYKKYIETILDYGTFRKGKCNIQYIKVKEYIPDIPDKE<br>FEDCEIGAYSGKIKALLRLNENLAKFLGYFVARGRLKEIKLK<br>GETVYEACVYKSLPEYQEEIAEVFKKAFGAGAIARDKVTLD<br>KKIVYLVLKYIFKCGYKGRKHIPEQLFLANEEVIKSFLDGFL<br>KAKKNSHKGTSTFMAKDEEYLNQLMLLFNLVGIPTRFTPVK<br>NKGYKLTLNPNYELVKDLMLDEVKEIEEFDYNGYVYDLSV<br>EEDENFLVNNIYAHNS (SEQ ID NO: 139) |
| Mja GF-6P | HCLHPDTYVILPDGRMKKISEIDEDEVLSVNFEDLKLYNKKI<br>KKFKHKAPKILYKIKTAFSELITTGEHKLFVVENGKIVEKCV<br>KDLNGSELIGVVRKLNYSFNDNVEFKDVYVERHYKLDETIR<br>NKLRKVREKLGLTRKDVEKLCGVKEIYIVKIETGKLESIEEE<br>RLKKLCSLYGINFEEIIYRDNLHYTNPVKFPKTPTPELMQIIG<br>YIIGDGHFPSNRMLRLKDERKEVLEEYNQLFKTVFNLEGNIK<br>KGDGNYYILEINSKYLIDWFRENIPELFNKTGNERTPEFVFR |

-continued

| 2. Table 2 | |
|---|---|
| | LNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNS (SEQ ID NO: 140) |
| Mja Helicase | LCLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHNS (SEQ ID NO: 141) |
| Mja Pol-1 | RCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNS (SEQ ID NO: 142) |
| Mja Pol-2 | NSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNS (SEQ ID NO: 143) |
| Mja RFC-2 | ASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNS (SEQ ID NO: 144) |
| Mka CDC48 | ESIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNS (SEQ ID NO: 145) |
| Mka RFC | ASVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHNS (SEQ ID NO: 146) |

-continued

| 2. Table 2 | |
|---|---|
| Mthe RecA | GCFDYSTRAQLADGTTEKIGKIVDNKMDVEVLSYDPDTDRI<br>VPRKVVNWFNNGPAEQLLQFTVEKSGGNGRARFAATPNHL<br>IRTPGGWTEAGDLIAGDRVLAAEPHRLSDQQFQIVLGSLMG<br>DGTLSPDPRGRNGVRFRMGHGADRVDYLEWKTALLGNIK<br>HSTGENAEGARFVDFTPLPELAELRRAVYLGDDGRKFISEE<br>YLKALTPLALAIWYMDDGSLTVRSEGLQQGTAGGSGRIEIC<br>VEAMTEGSRIRLRDHLRDTHGLDVRLRQAGAGGKAVLVFS<br>TAATAEFQELVAPYMAPSMEYKLLPRFRGQSRVVPQFVEPT<br>QRLVPARILDVHVEPHTRSMNRYDIEVEGNHNYFVDGVMV<br>HNS (SEQ ID NO: 147) |
| Mvu-M7 Helicase | LCLNAKTEILQENGYRKITELNKNEKIFALCGGKIKPIGRWKI<br>HKTPQHDYNITIKTENGLEITTTPNHIFLVKNGKSIKEKEAKD<br>LKIGDLVATVGKIIVDEDINTSNFVKFPIRRLSQFIAETFNSKG<br>VINNSIEIYSTSELFIKRLQVALLRFGIHSQIEIKNSDKKDDKT<br>YLLKISDLEGLKLFYKNFPIDLKEKEKLFYLIKKKINNKPYE<br>DNLEHIDFDNSFNNIAICWKKILEIKKVKVEDEYVYDIELPN<br>DGSNDHYFVANGFVVHNS (SEQ ID NO: 148) |
| Mvu-M7 Pol-1 | RCHPRGTKVIVKNNGLTDIENVKVGDYVLGIDGWQKVKRV<br>WKYPYNGFLVNVNGLKSTPNHKIPVIKKENGKDRVIDVSSI<br>YLLNLKGCKILKIKNFESIGMFGKIFKKDTKIKKVKGLLEKI<br>AYIDPREGLVIKVKNEKEDIFKTVIPILKELNILYKQVDEKTII<br>IDSIDGLLKYIVTIGFNDKNEEKIKEIIKEKSFLEFKELEDIKISI<br>EEYEGYVYDLTLEGRPYYFANGILTHNS (SEQ ID NO: 149) |
| Mvu-M7 Pol-2 | NSILPDEYLTVIEDDGVKIVKIGEYINRLMEKYPNKIKLSEVL<br>EVKNLKTFSFNKLTKKCEIKKVKGLIRHKYEGKAYKIKLRS<br>GRTIRVTEGHSLFKYENGEIVEVKGNEIKINDLIVVPRKIAHI<br>NKKIVINIPKRLVDADEEDIKNLVITKHKDKIHFIKLKKTLED<br>IERNKFNVIFDDCILYLKKLGLIDYNIIKAINKVEIKILDKKKF<br>KIYKKYIDTIIEHGNFARGRSNIQYLKIKDLINDIPDEEFEDCE<br>IGALCGKINALLKLDENLAKFLGYFVTRGGLNKYKAKEGTT<br>HEVAIFKSLPDYQKEIVKIFKKTFGAGCISKDKVIMDNKIVY<br>LILKYIFKCGNKNKKHIPEEIFLADEKVIKSFLDGFLKAKKNS<br>HKGTTTFMAKDEDYLNQLMILFNLVGIPTRFTPVKNKGYKL<br>TLNPNYKLINDLMLDEVKEIEEFNYNGYVYDLSVEDNENFL<br>VNNIYAHNS (SEQ ID NO: 150) |
| Nma-ATCC43099 MCM | RCVTGDTLVHTGDGIKPIRELAHEAVPSGSIEELKNGRTIRD<br>VDVDVLTMTEDGSIVKRDVSAIHEYDAPDELHEITLESGEQ<br>LTTTADHPFFVLNEGNREERQAQDLNENDWIFVPDTIPATV<br>ADGGVSVLPSADAETETNRLSPSHGAILGYIAGDGNIFYDRD<br>EGCYGFRFTNNEEELLSDFEETCTNAFSTQAVRHPSEQRAD<br>GVETVRVHGKQYVDELLDSGANLENYDGKRLPEAVTSASR<br>ETKSAFIRALADSEGTVDKRAVKLFSSSYELLLGTKMLLLEF<br>GISSQIQTRPRDGGRDLFILAITSRESLEAFKRSIGFTLKRKHR<br>ALERACERTTGDRTILDVLPECGELFEQARGALRLYQSECG<br>LENDSTYCNFENGDANASLRLSRPILEAFEDRKLAAKEHYS<br>ELISEASWERLAELREQYHISQQELAAEMSISQQQLSAQWG<br>GDFELQEQVRYRLRDLLETPASVDLDPLRGLIESDVKWRRV<br>ETIRRIDSREHTDARVRVLEQRLADEIGAETVDSVRESARSLI<br>ETENSAETWDELRIRLETYGISFQQVAAEMDVAGSTVSRWF<br>SGTVDVDNFEAVRSVCEELLNAKRRRISELLQEIDRRDQPR<br>VYDLTVEGTHNFVANGMVVHNS (SEQ ID NO: 151) |
| Nma-ATCC43099 PolB-2 | NCFTPDTEVLTPDGVRDITDLEVGDEVYSLDPETEALEVKP<br>VVETHAYPEYDGDLVDIETNKIDFRVTPNHRMLVRKNETN<br>GITEDEYSFIEAGDLDRATNYELPHDWDGPDGNELDTVDLT<br>ELIDGEYEVWVRPSVHGHTFTTELGWKPRRVPKADVGKTG<br>YVFTAEEFEAHREYIEEVCETSFIHRDSGRKWIPRTYDGDKF<br>LDLLAWFVTEGNVYTSEDKQFGENFRGSATTVKLAQDKLPI<br>ADGGLGHHATIGELLDEMGFDYYVDDRSYTVTSKLLGNFL<br>TSCCGDGSFEKRIPELVFECSHRQKRRFLEVLIDGDGDRQTN<br>SWRYTTSSNRLRDDVLRLCAHLGLTANYSRDSGTWRIYVT<br>EGSKNTLRMHRSSTQSTADNGVYCVTVEDNHTLLAGRNGK<br>FQFVGQS (SEQ ID NO: 152) |
| Pab Lon | QCFSGEETVVIRENGEVKVLRLKDFVEKALEKPSGEGLDGD<br>VKVVYHDFRNENVEVLTKDGFTKLLYANKRIGKQKLRRVV<br>NLEKDYWFALTPDHKVYTTDGLKEAGEITEKDELISVPITVF<br>DCEDEDLKKIGLLPLTSDDERLRKIATLMGILFNGGSIDEGL<br>GVLTLKSERSVIEKFVITLKELFGKFEYEIIKEENTILKTRDPR<br>IIKFLVGLGAPIEGKDLKMPWWVKLKPSLFLAFLEGFRAHIV<br>EQLVDDPNKNLPFFQELSWYLGLFGIKADIKVEEVGDKHKII<br>FDAGRLDVDKQFIETWEDVEVTYNLTTEKGNLLANGLFVK<br>NS (SEQ ID NO: 153) |

-continued

| 2. Table 2 | |
|---|---|
| Pab RIR1-2 | ACFTGDTRILTEKGLIPIEEIVHETGKKPKVVTHAGLKDIIET YDNGEMEVFRVTTEDGYELKVTGDHKFLVFDENGNPTLKP LKELKVGDYVYILAPEWKGGEYVELDTNIELKGKGYNVNL PSKLDEKLAYLLGIIYADGHIRHYFENGKRKNSKIEIYLHQD ETEIKEKVKRYFKEIFGIEPKEFLKEEQHKVILVIPSTKIVKFL EINGLLKDKSENIRVPEAIFRSRPSVIAAFLAGFFDGDGSIDQ NYRIAFKSISREFIKEAQLLFLALGIVTSIQEYNPPNPNNKTV YTLRVQTRDMKIKAFNVLKESVKLSKIMKEAISKLEENGKN KKFSFPFNAIYHIKDPKIRAKIQRDYKILSYNSKVTHRAFINN ILKLKEELGLDDEEVKYFEMLSKLYPTKITKIEPLGKAHVYD LQVEDVHLLTGNGIYTSNS (SEQ ID NO: 154) |
| Pfu Lon | QCFSGEEVILIEKDGEKKVFKLREFVDGLLKEASGEGMDGSI RVVYKDLQGENIKILTKDGLVKLLYVNRREGKQKLRKIVNL EKDYWLALTPEHKVYTIKGLKEAGEITKDDEIIRVPLTILDG FDVAEKSIREELERLSLLPLNSEDSRLEKIAGIMGALFGSGGI DENLNTLSFVSSEKKTIEQFVKALSELFGEFDYKIEEKENSIIF RTCDKRIVTFFATLGAPVGDKSKVKLKLPWWVKLKPSLFL AFMDGLYSSNRNDKEILEITQLTDNVETFFEEISWYLSFFGIK AEAEEDEEKDKYRARLTLSSSIDNMLNFIEFIPISFSPAKREK FFKEIEKYLEYSIPEKTEDLKKRVKRVKKGERRNFLESWEEV EVTYNVTTETGNLLANGLFVKNS (SEQ ID NO: 155) |
| Pho LHR | VCVSGDSKVLTEKGPVEIRHLNSGMIVGINGFKSRFVKFQEL HQVKYQEYGVKIRTQLGFEVKCTREHRFLTIDKNGELRWV EAWRLKEGDYVGIIRKLPSPNSKVLILDFLPESTYLWLNKEF LKKLKVSIKEKFGSIKNYAKERGFNSSYLVKQLNGLSPFRW GRLRVILNDVSIEISRDDIERITSRRGKYSLPPELTPGIARLLG FWMASGSLNRNTLIFYSQDKKILERYEDLCKREFRVKGRIK AQDKGTYILEIPSSLLSFVFKNLARPKLEVPPIIYILPEKHKEE FLAGYFDGNGFIKIENGRIHSLGFFAFNRKFAEGIRDILLQLG ILSSINEQTFEVSIIEGEKFLKIVNSWRSNYYKEWEDVIPNLE KRLKEIEEKLGYPGTYNRREIRRSELKAIIKLYEKVARERGL NDVLKELSYLKELSEGDIFFDRITSIEPVYLDVAYGIINSETG NYVVNGFVSKNS (SEQ ID NO: 156) |
| Pho Lon | QCFSGEEVIIVEKGKDRKVVKLREFVEDALKEPSGEGMDGD IKVTYKDLRGEDVRILTKDGFVKLLYVNKREGKQKLRKIVN LDKDYWLAVTPDHKVFTSEGLKEAGEITEKDEIIRVPLVILD GPKIASTYGEDGKFDDYIRWKKYYEKTGNGYKRAAKELNI KESTLRWWTQGAKPNSLKMIEELEKLNLLPLTSEDSRLEKV AIILGALFSDGNIDRNFNTLSFISSERKAIERFVETLKELFGEF NYEIRDNHESLGKSILFRTWDRRIIRFFVALGAPVGNKTKVK LELPWWIKLKPSLFLAFMDGLYSGDGSVPRFARYEEGIKFN GTFEIAQLTDDVEKKLPFFEEIAWYLSFFGIKAKVRVDKTGD KYKVRLIFSQSIDNVLNFLEFIPISLSPAKREKFLREVESYLAA VPESSLAGRIEELREHENRIKKGERRSFIETWEVVNVTYNVT TETGNLLANGLFVKNS (SEQ ID NO: 157) |
| Pho Pol I | NSILPDEWLPIVENEKVRFVKIGDFIDREIEENAERVKRDGET EILEVKDLKALSFNRETKKSELKKVKALIRHRYSGKVYSIKL KSGRRIKITSGHSLFSVKNGKLVKVRGDELKPGDLVVVPGR LKLPESKQVLNLVELLLKLPEEETSNIVMMIPVKGRKNFFKG MLKTLYWIFGEGERPRTAGRYLKHLERLGYVKLKRRGCEV LDWESLKRYRKLYETLIKNLKYNGNSRAYMVEFNSLRDVV SLMPIEELKEWIIGEPRGPKIGTFIDVDDSFAKLLGYYISSGD VEKDRVKFHSKDQNVLEDIAKLAEKLFGKVRRGRGYIEVS GKISHAIFRVLAEGKRIPEFIFTSPMDIKVAFLKGLNGNAEEL TFSTKSELLVNQLILLLNSIGVSDIKIEHEKGVYRVYINKKES SNGDIVLDSVESIEVEKYEGYVYDLSVEDNENFLVGFGLLY AHNS (SEQ ID NO: 158) |
| Rma DnaB | GCLAGDTLITLADGRRVPIRELVSQQNFSVWALNPQTYRLE RARVSRAFCTGIKPVYRLTTRLGRSIRATANHRFLTPQGWK RVDELQPGDYLALPRRIPTASTPTLTEAELALLGHLIGDGCT LPHHVIQYTSRDADLATLVAHLATKVFGSKVTPQIRKELRW YQVYLRAARPLAPGKRNPISDWLRDLGIFGLRSYEKKVPAL LFCQTSEAIATFLRHLWATDGCIQMRRGKKPYPAVYYATSS YQLARDVQSLLLRLGINARLKTVAQGEKGRVQYHVKVSGR EDLLRFVEKIGAVGARQRAALASVYDYLSVRTGNPNRDIIP VALWYELVREAMYQRGISHRQLHANLGMAYGGMTLFRQN LSRARALRLAEAAACPELRQLAQSDVYWDPIVSIEPDGVEE VFDLTVPGPHNFVANDIIAHNS (SEQ ID NO: 159) |

-continued

| 2. Table 2 | |
|---|---|
| Rma-DSM4252 DnaE | RCVAEGTLIVDARTGRRVPVEEVQPGMEVWSLGPDLRLHR VPVQARFDNGIQTVYKVRTRTGRTIELTAEHPLLTLQGWKH LCDLKVGDAIAVPISLATEGDLSPDPARVKLLAYLLGDGNT VHRTPRGDAPTARFFTSSPALRNDFLNAVQTLGGQVRIYKH PITGVETIYCTAPKGQADPVLTLIREVGLIGRAHEKRVPEEVF RYTQAALRLFLGRLWSTDGSIEKKRLSYCSTSMELIEDIAHL LLRLGINTIRRQRTTTHRPAFELVITDQRDIVLFARQIGPYLV GDKKKRLKALVRQALQRVRNQSIYLIPAEVGHLVRAAKVK SGLSWTHAGARVGVPGTSLSAGLNLKTPRRALSRHRTALL GRAFADETLLALSEGEVLWDPIVEITPVGRKRVYDLAVPPF ANFVAQDIVVHNS (SEQ ID NO: 160) |
| Tag Pol-1 (alternative name: Tsp-TY Pol-1) | RCHPADTKVIVKGKGIVNISDVKEGDYILGIDGWQRVKKV WKYHYEGKLININGLKCTPNHKVPVVTENDRQTRIRDSLAK SFLSGKVKGKIITTKLFEKIAEFEKNKPSEEEILKGELSGIILA EGTLLRKDIEYFDSSRGKKRISHQYRVEITIGENEKELLERIL YIFDKLFGIRPSVKKKGDTNALKITTAKKAVYLQIEELLKNIE SLYAPAVLRGFFERDATVNKIRSTIVVTQGTNNKWKIDIVA KLLDSLGIPYSRYEYKYIENGKELTKHILEITGRDGLILFQTL VGFISSEKNEALEKAIEVREMNRLKNNSFYNLSTFEVSSEYY KGEVYDLTLEGNPYYFANGILTHNS (SEQ ID NO: 161) |
| Tag Pol-2 (alternative name: Tsp-TY Pol-2) | NSILPNEWLPIIENGEVKFVKIGEFIDRYMEEQKDKVRTVDN TEVLEVDNIFAFSLNKESKKSEIKKVKALIRHKYKGEAYEVE LNSGRKIHITRGHSLFTIRNGKIKEIWGEEVKVGDLIIVPKKV KLNEKEAVINIPELISKLPDEDTADVVMTTPVKGRKNFFKG MLRTLKWIFGEESKRIRTFNRYLFHLEELGFVKLLPRGYEVT DWEGLKRYRQLYEKLVKNLRYNGNKREYLVRFNDIKDSVS CFPRKELEEWKIGTXKGFRXKCILKVDEDFGKFLGYYVSEG YAGAQKNKTGGMSYSVKLYNENPNVLKDMKNIAEKFFGK VRVGKNCVDIPKKMAYLLAKSLCGVTAENKRIPSIIFDSSEP VRWAFLRAYFVGDGDIHPSKRLRLSTKSELLANQLVFLLNS LGVSSIKIGFDSGVYRVYINEDLPFLQTSRQKNTYYPNLIPKE VLEEIFGRKFQKNITFEKFKELADSGKLDKRKVKLLDFLLNG DIVLDRVKNVEKREYEGYVYDLSVEDNENFLVGFGLLYAH NS (SEQ ID NO: 162) |
| Taq-Y51MC23 DnaE | KCLPARAKVVDWRTGRVVSLGEIVRGEAQGVWVVSLDED RLRLVPRPVVAAFSSGRAQVYALRTATGRVLEATANHPLFT PQGWRPLGALAPGDYVALPRHLPYRPSAHLEDHELDLLGF ALSEGNLRHPSGFYLYTSSEEELAAMEEALKRFPNTRTRVA WRRGVAHLYVGRQDRRREAGAVAFLREQGLLGLSAREKR LPEVAYRLPPEEVARFLGRLWTGDGGVDPRGRLIHYATASR ALAEGVQHLLLRLGLQSRLVEKRFAYKEGRTGYAVYLLGG LEAAHRFAQVIGPHLIGKRRRDLEALLASWEAAGRSTKDIL PLAFLDTVKAALAEASRGQVAALLKEAGLAQGLLRPGRGR LGLSRATLERLAALTGNLALLRLAQAEVYWDRVEAIEPLGE EEVFDLTVEGTHTFIAEDVIVHNS (SEQ ID NO: 163) |
| Tcu-DSM43183 RecA | GCMSYGTRVTLADGTQEKIGKIVDQKMDVEVLSYDPQLDK IVPKRVVNWFDNGNAERFLQFTVAKSGGNGRAQFAATENH LVRTPGGYREAGELIAGDRVMVMETHRLSDQQWQVVLGS VMGDGSLSPNRRGRTGVRFRMGHGAGQAAYLDWKVSLLG NIPCTRSVNAKGAVFADFTPLPELDELRRVVYFGDGKKHLT WDYLKALTPLALAIWYMDDGHLAVPSKELQDRTAGGSGR VEICVEAFSPGSRERLVEYLRDTHGLDVRLIERGARKAGVL QFTTAASAKFQELIAPYVHESMDYKLLPRLRGRCTVEPQFV DPEPRLVPAQILDVRVKPKTRSMRRFDIEVEGAHNYFVDGV MVHNS (SEQ ID NO: 164) |
| Tfus RecA-2 | GCMHYDTLVTLADGTQEKIGTIVDRKLDVEVLSYDPETDRI VPRRVVNWFDNGAADHFLQFTVGRSGKPGGAQFTATPNHL IRTPGGWREAGELIAGDRVLVHEPHYLNEQQRQVVYGSLM GRGTLVPDRHGGPGVHFCMAHTAEQAAYLDWKVSLLGNI AHSRTAEASATVGVEFTPMPELSELHRVVDFGDGHTHLTW EFLKQLTPLALAVWYLDAGTLTIPQSGTDDDARVQIDVETL SPGSRQRLVEYLRDTHELDAAVVQQGADARSLLEFTPAAT VRFLELVAPYVPESMSSMLLAQFRGRCSVTPEYSDPVQRLV AAPVLDIQVKPGSTRKFDIEVEGNHNYFVDGVMVHNS (SEQ ID NO: 165) |
| Tfus Tfu2914 | YCVDEETEILTTDGWKTFRETAPGDLALTLNHSTGLAEWQP ILDVYVFPAQPRTMIRMEGRTHSSLTTPQHRWPVERATRTT AASEETRRERTWATTETLTDGDRIPQAAPCRDLPTEPKWSD ALVELVAWLWLGDHATRSRHSATLALSQRDGLGAARIRAA LHSLFGPPAPQPSRGGRRPWWRERLTRSCVEFHLSPGASRM |

-continued

| 2. Table 2 | |
|---|---|
| | LLEHIPDGAVSFGFLRSLTRAQLNLFIDTSVRACRAHGTTTA<br>SRTALVHRDRRRAEAFQFAAILAGYPASLRHRTLPGPAPAD<br>VWLVHLDTAQDFAPKAATPGLTIAEEPYTGRVWCVRTPNA<br>TWLARRAGTVYFTGNS (SEQ ID NO: 166) |
| Thy Pol-1 | NSLLPEEWIPLVENGKVRLHRIGEFVDKLMETDSELVKRNG<br>DTEVLEVRGIRALSFDRKSKKARVMPVKAVIRHRYSGDVY<br>EIVLGSGRRITVTEGHSLFAYGDGELREVTGGEIKAGDLLAV<br>PRRVNLPEKKERLNLVELLRRLPEEETGDIILTIPVKGRKNFF<br>KGMLRTLRWISGEEKRPRTARRYLEHLEGLGYVRLKKIGYE<br>VTDREGLERYRKLYERLVEAVRYNGNKREYLVEFNAVRDV<br>IALMPEEELRDWLVGTRNGFRMRPFVEIEEDFAKLLGYYVS<br>EGNARKWRNQKNGWSYTVKLYNENQRVLDDMESLAERFF<br>GRVKRGKNYIEIPRKMAYIIFENLCGTLAENKRVPEAIFTSPE<br>SVRWAFIEGYFIGDGDVHPSKRVRLSTKSELLVNGLVLLLN<br>SLGVSAIKIRHDSGVYRVYVNEELPFTDYRKKKNAYYSHVI<br>PKEILEETFGKVFQRSVSYEKFRELVKSEKLDGEKAKRIEWL<br>LNGDVVLDKVLEVKKRPYEGYVYDLSVEEDENFLAGFGLL<br>YAHNS (SEQ ID NO: 167) |
| Tko Helicase | LCMHPDTYVVTKSGAKKVSELTEGDEVLTHTGTFKKVIQPL<br>RREHKGRLLVIKAYGTVPVKITPEHMVWVVKQIRHKSHYS<br>DGRQVIWWEFEGPEWMTAQELKERLESETDPKVSYMLLQP<br>IPEPSVDADKIPLRKEVYVVNQHGKTDKLHPSVKRTPEYLPL<br>NFETARLIGLWIAEGSTSKNGVIKFDISSNEEDLTEFITGTIRK<br>YFPHAKIVVKDHERNRRTVRFCNKRFAEWLRENIGHGADN<br>KSIPPLLLLNKNREVRLGLLRGLIEGDGYVRRESQRRANYIS<br>YSTVSPSLAYQLQLLVASLGYTSSIHRSIRTEGIGKTRKPIYD<br>VKVSGKSYYSLLEELGFEVPQRGNRTYNVNRTWKNYLLLK<br>VRSIEEEEYEGDVYNLEVEGDESGSVGFIVHNS (SEQ ID NO:<br>168) |
| Tko LHR | VCVSGDSKILTGKGPVEIGRLNSNMIAGIWRFQTELVRFEEP<br>HRVEYRREGVKIRTRLGFEIKATKEHKFLTVDENGELRWVE<br>AWKLKEGNWVGVVRRLPSPNVKVSILDLLPPNAYLKLKGE<br>FLRELKLSIQAKFGSIRTYAKKKRWSESYLVKQLNGVYPFR<br>WERLSAVLKDLDLRMTENDVERITSDKGKYSLPIEFTPSMA<br>RLLGFWMADGSWKGGTLTLFSSDRKMLEKYKELCKEEFG<br>VVGRIRMLNESTYSLEISFNLLPAIFKNLTGNTERKSKLGTFP<br>SIIYSLPEEHKREFLAGYFDGDGFLEVKGGRVYSAGFSTFNK<br>RFAEGIRDILLQLGIVSSIRAREYDEVQKFKGRVIPKKGASYT<br>VSVLGGEYLKRFFDAVRPWRSDYEGWEGMYNEGYSNSDV<br>VPNLGKRLRSIRERLGISAYRMSKMGFYNPVRVELGEREISR<br>RNLRLLVEFYERVAKEKRVEDVLEELSYLRELAEGDVFFDR<br>ITSVEPAYIDVAYGIINSETENYIVEGFISKNS (SEQ ID NO:<br>169) |
| Tko Pol-1 (alternative name:<br>Pko Pol-1) | RCHPADTKVVVKGKGIINISEVQEGDYVLGIDGWQRVRKV<br>WEYDYKGELVNINGLKCTPNHKLPVVTKNERQTRIRDSLA<br>KSFLTKKVKGKIITTPLFYEIGRATSENIPEEEVLKGELAGILL<br>AEGTLLRKDVEYFDSSRKKRRISHQYRVEITIGKDEEEFRDR<br>ITYIFERLFGITPSISEKKGTNAVTLKVAKKNVYLKVKEIMD<br>NIESLHAPSVLRGFFEGDGSVNRVRRSIVATQGTKNEWKIKL<br>VSKLLSQLGIPHQTYTYQYQENGKDRSRYILEITGKDGLILF<br>QTLIGFISERKNALLNKAISQREMNNLENNGFYRLSEFNVST<br>EYYEGKVYDLTLEGTPYYFANGILTHNS (SEQ ID NO: 170) |
| Tli Lon | QCFSGEESIVIEKGKEKRVFKLREFVDSALKEPSGEGMDGKI<br>RVVYKDLQGEDVKILTKDGFVKLLYVNRREGKQKLRKIVN<br>LEKDYWLALTSEHKVYTARGLKEAGEITKDDEIIRIPITVLD<br>KFDVARTYNEEEKLKAYLRWKEYHEKTGNGYKKAAKELG<br>IKESTLRWWTQGAKPNSLKMIEELEKLNLLPLNSEDSRLEKI<br>ARILGALFSDGSIDKNLNTLSFVSSEKEAIELFVKTLGELFGD<br>FDYEIKENRESRGRSILFRTWDRKIIRFFVALGAPAGNKTKV<br>KFELPWWIKLKPSIFLAFMDGFYSGDGSVPRFARYKDGIKF<br>NGSLEIAQLTDELEKKLPFFEEIAWYLSFFGIKAKVRVDEAR<br>GKYKVRLILSQSVDNVLNFLEFIPISFSPAKKEKFLREVEKYL<br>AEVPESSLAERFGELKERFEKIKRGQRRHFIESWEEVEVTYN<br>VTTETGNLLANGLFVKNS (SEQ ID NO: 171) |
| Tli MCM-1 | KCVEYNTEVVLSDGSIKPIGELVDEAIEKAKERGTLGVVDD<br>GYYAPIDLEIYALDASTLKVRRVKANIAWKRTAPERMFRIK<br>TASGREIKVTPTHPFFVFDEGTFKTRKAEELKVGDKIATLRR<br>ENEPIEIPETKNEHLKKLLASSDIFWDRIEEIEEYKPEHPWVY<br>DLQVPEHHNFIANDIFVHNS (SEQ ID NO: 172) |

-continued

| 2. Table 2 | |
|---|---|
| Tli Pol-1 | NSILPNEWLPIIENGEIKFVKIGEFINSYMEKQKENVKTVENT EVLEVNNLFAFSFNKKIKESEVKKVKALIRHKYKGKAYEIQ LSSGRKINITAGHSLFTVRNGEIKEVSGDGIKEGDLIVAPKKI KLNEKGVSINIPELISDLSEEETADIVMTISAKGRKNFFKGML RTLRWMFGEENRRIRTFNRYLFHLEKLGLIKLLPRGYEVTD WERLKKYKQLYEKLAGSVKYNGNKREYLVMFNEIKDFISY FPQKELEEWKIGTLNGFRTNCILKVDEDFGKLLGYYVSEGY AGAQKNKTGGISYSVKLYNEDPNVLESMKNVAEKFFGKVR VDRNCVSISKKMAYLVMKCLCGALAENKRIPSVILTSPEPV RWSFLEAYFTGDGDIHPSKRFRLSTKSELLANQLVFLLNSLG ISSVKIGFDSGVYRVYINEDLQFPQTSREKNTYYSNLIPKEIL RDVFGKEFQKNMTFKKFKELVDSGKLNREKAKLLEFFINGD IVLDRVKSVKEKDYEGYVYDLSVEDNENFLVGFGLLYAHN S (SEQ ID NO: 173) |
| Tli RFC-2 | ASVSKDTPILVRLNGKVMRTTFAELDKIYFDENDGEVAYKD AMNLEVLTVDENYKVRWARVSKIIRHRVPVILKIHLEGGGT LELTGNHSVMVLTENGLESVKASELKEGSYLLSFVSSVPGF LDVLNMEDYTVKPSARVRTFGEIPLNDELAYMMGLYAAEG AVSFKGVTSGQVIYTLGSHEGELIERVREFAEGLGVSVYEN YTTSGFDRSRRSAYQIRLLSTQLARFFEDNFYDGHGRRSEN KRVPGFIFEASLEERIAFLKGLADVDGSGEWESVVRVSSVSK DMLIDTVWLARISGIEASLFEREARLIWKGGMKWAKAELLP AEPIIKMLLRIEDAVEGNWRYNFRHQLYEGKKRVGKGILRD VLDMVNVEKLDDEGREIYETLRKLAYTDLHALAIRKIELIEY NDFVYDVSVPGNETFFAGEIPVLLHNS (SEQ ID NO: 174) |
| Ton-NA1 LHR | VCVPGHSKIFTAEGTRRIDRLGEKTAIVGVEETRSRFVGFDG THKIEYNTKGVKIRTRLGFEVEATLGHKFLTVKDGRLTWVE AGELKPGDYVGVLRRLPSPEKEVPIFEVLPGSAYLHLRAEFL RELKRNIQAKFGSIKAFAKRWNMGESHLSKQLRGEYPFSWE RLKLILSEVDMTIEEDDVERITSDKNSYKLSKKFTPGMARLL GFWLADGSWKGGTVTLFSGDLEMLKRYAELAKQEFGIDGH IRRQNESTYALELSFNVLLHLFSGLVGKNKKSKFGVFPEILY RLPMKHKIQFLSGYFDGDGYLEVKGGRIYSAGFVTFNPEFA EGIRNLLLQLGIVSSLRSQDYDEEQFFRGRTVPKKGTSYTVA VLGGDYLRTFGELIEPWRPNLRKIKGLSTGYSNRDVIPNLGK KLREIRETLGISSYRLQKMGIYNPMKVELGTREISRRNLVRL LDFYEMVAKEREMSDVLAEIQRLKELAEGDVFFDRIESIEPV FIKEAYGILNSETGNYVVNGFVSKNS (SEQ ID NO: 175) |
| Ton-NA1 Pol | NSILPDEWVPLLIDGRLKLTRIGDFVDNAMDEGNPLKSNETE VLEVLGINAISFNRKTKISEVRPVRALIRHRYRGKVYSIKLSS GRKIKVTEGHSLFTVKNGELVEVTGGKVKPGDFIAVPRRIN LPERHERINLADVLLNLPEEETADVVLTIPTKGRKNFFRGML RTLRWIFEGEKRPRTARRYLEHLQKLGYVRLKKIGYEVLDE KALRKYRALYEVLAEKVRYNGNKREYLVAFNDLRDKIEFM PEEELREWKIGTLNGFRMEPFIEVNEDLAKLLGYYVSEGYA GKQRNQKNGWSYSVKLYNNDQKVLDDMERLASKFFGKVR RGKNYVEMPKKMAYVLFKSLCGTLAENKRVPEVIFTSPEN VRWAFLEGYFIGDGDLHPSKRVRLSTKSETLVNGLIILLNSL GISAVKIRFESGVYRVLVNEELSFLGNSKKKNAYYSHVIPKE ILEDVFEKRFQKNVSPKKLREKIKRGELNQEKAKRISWLLEG DIVLDRVEEVEVEDYNGYVYDLSVEENENFLAGFGMIYAH NS (SEQ ID NO: 176) |
| Tsi-MM739 Lon | QCFSGKESIIIEKDGERRVVTLKEFVDSALKEPSGEGVDGEIN VIYKDFRNDKVKILTKDGFVKLLYANRREGKQNLRRIVNLE KDYWLTVTPEHKVYTAEGLKEMDELTKDDEIIRVPVIILDRF DVARTYNEEKKLKDYFRWKDYYEKTGNGYKRVAKELGIK ESTLRWWTQGAKPKSLKMAEELEKLGLLPLKNEDERLEEIA KVMGILFSDGNIDKNLNTLSFVSSEREAIEKFVRILGNLFGEF EYEIKENREAMGESILFRTWDRRVIRFFVALGAPVGNKTMV KLELPWWIKLKPSLFLAFIDGLYSGDGSVPRFAHYRDGIKFN GTLEIAQLTDELEKKLPFFEEIAWHLGLFGIEAKVRVDKADG KYKVRLIFSQSIDNVLNFLEFIQISLSPSKRERFLGEVEKYINA VPDSSLAEKLKEFKERFERIKKEERRNFIESSEEVEVTYNVTT ETGNLLANGLFVKNS (SEQ ID NO: 177) |
| Tsi-MM739 Pol-1 | NSILPNEWLPIIENEEIKFVKIGEFIDRYMEEQKDRVRTVDNT EVLEVDNLFALSLNRESKESEVKKVRALIRHKYRGKVYAIG LNSGRKITVTGGHSLFTIRKGEIREVSGAEIKAGDLIVVPKKV KLNEKEVTINIPELILRLPDEATADIVMTIPVKGRKNFFKGM LRTLRWIFGEESKRIRTFNRYLFHLEKLGFVKLLPRGYEVTD WEGLKIYKQLYEKLVESLRYNGNKREYLVMFNDIKDVISSF PQKELEEWKIGTLNGFRMDCILKIDENFGKLLGYYVSEGYA GAQKNKTDGISYSVKLYNENPNILGDMKNAAERFFGKVRV |

-continued

| 2. Table 2 | |
|---|---|
| | GKNCVSISKKMAYLLMKCLCGVTAENKRIPPIIFNSPEPIRW<br>AFLEAYFAGDGDVHPSKRLRLSTKSELLANQLIFFLNSLGVS<br>SVKIGFDSGVYRVYINEDLQFLRTSREKNTYYSNLIPKEILEE<br>IFGRKFQRNITFEKFKEFVDSGKLDKRKAKLLDFVLNGDIVL<br>DRVKNVKKREYEGYVYDLSVEGNENFLVGFGLLYAHNS<br>(SEQ ID NO: 178) |
| Tsi-MM739 RFC | ASVSKDTPILVRINGRVMRTTFAELDKLYFNESDGEVAYKD<br>ASNLEVLTVDENYCVKWAQVSKIIRHHVPVILHVHLEGGG<br>KLELTGNHSVMVLTENGLETVKASELKEGTILLSFTTNIEGF<br>LDVLDMSDYSIKESARTRTFKGLSVDEELSYIFGLYAAEGA<br>VGFNGNTSGQVIYTLGSHEGQLIERIKAFVENLGVSVYENY<br>TSSGFDRSRKSAYQFRLLNTQLARFFEESFYDGNGRRANNK<br>RLPGFVFEFPIRERIAFLKGLADGDGTGEWGGVIRVSSVSRD<br>LLIDTVWLARVSGIEASLFEREARLIWKGGMKWSKAELLPA<br>EPIVKMLEAIENAIEGNWRYEFRHQLYEGKKRVRKATLRKA<br>IEMVNEEKLDEKGKRILEVLKKLANTDLHALLVRKIELVEY<br>NDFVYDVSVPGNEMFFAGEIPVLLHNS (SEQ ID NO: 179) |
| Tsp-AM4 LHR | VCVPGHSKIITSRGIRRIDGLSVDEEIVGVKESRSRFVEFGGT<br>HRIEYNSTGVKLKTRLGFEVEATREHKFLTIKDGKLTWVEV<br>EKLKPGDYVGVLRRLPSPDEEVPIFEILPDSAYLHLRTEFLRE<br>LKKNIQTKFCSINAFARKLGMSGSYLSKQLLGEYPFRWSKL<br>KVVLQEVGMTLDESDVVRITSDKNSYELPKRFTPGLARLLG<br>FWIADGSWKDGTVTLFSSDLDMLKHYAKLAKEELGIEGSIR<br>KQNENTYSLELSFNVLFHMFREFVGNGGKKSLNGRFPEILY<br>RLPKEHKAQFLSGYFDGDGYLEIKEGKRVYSAGFATFNPEF<br>AEGIRNLLLQLGIVASIRRRHYNERQFFRGREIRKTGTSYTV<br>AILGGEYLRKFAELVEPWRPGLRKIKEIPVEGYSNHDVIPGI<br>GKRLRKLRETLGITSYMLQKAGFYNPVKVELGTREISRRNL<br>VKLLNFYERVAGEGKVEGVIPEIEELRKLAEGDVFFDRIESV<br>ESVFIADAYGILNSKTGNYVVNGFVSKNS (SEQ ID NO: 180) |
| Tsp-AM4 Lon | QCFSGNESVVIRENGKIKAVKLKNFVENALKNPSGEGTDGD<br>VRVVYHDFRNENVEVLTREGFTKLLYANKRVGKQRLRRIV<br>NLEKDYWLALTPDHRVYTPSGLKEVGELTERDELISVPVVV<br>LDEFGIAGTYGEEDKLRDYFRWMEHRERTGHGYKRASKEL<br>GIKASTLRWWEKGAKPKSLKMAEKLKGLDLLPLRSDDERL<br>EKVALLVGALFSDGNIDRNLNTLSFISSEKEAVERFVDTLRE<br>LFGEFDYEIKENREAKGRSVLFRTWDRRVIRFFVALGAPVG<br>NKTRVRLELPWWVKLKPSLFLAFFDGFYSGDGSVPRFARY<br>KEGIKFNGTLEVAQLAEELEDKLPFFEELAWHLGLFGIDAK<br>VRVDEARGKHKVRLILSQSIDNVLTFLELVPISLSPAKREKFI<br>AEVEKYLNEAGDSRHADRLDELRKWFERVKKSEKRTFVET<br>WEEVEVTYNLTTERGNLVANGLFVKNS (SEQ ID NO: 181) |
| Tsp-GE8 Pol-1 | NSILPDEWLPLLVNGRLKLVRIGDFVDNTMKKGQPLENDGT<br>EVLEVSGIEAISFNRKTKIAEIKPVKALIRHRYRGKVYDIKLS<br>SGRNIKVTEGHSLFAFRDGELVEVTGGEIKPGDFIAVPRRVN<br>LPERHERINLIEILLGLPPEETSDIVLTIPVKGRKNFFKGMLRT<br>LRWIFEEEQRPRTARRYLEHLQKLGYVKLMKRAYEIVNKE<br>ALRNYRKLYEVLAERVKYNGNKREYLVHFNDLRNEIKFMP<br>DEELEEWKVGTLNGFRMEPFIEVGEDFAKLLGYYVSEGYA<br>RKQRNQKNGWSYSVKIYNNDQRVLDDMEKLASKFFGRVR<br>RGKNYVEISRKMAYVLFESLCGTLAENKRVPEVIFTSPESVR<br>WAFFEGYFIGDGDLHPSKRVRLSTKSEELVNGLVVLLNSLGI<br>SAIKIRFDSGVYRVLVNEELPFLGNRKRKNAYYSHVIPKEIL<br>EETFGKQFQKNMSPAKLNEKVEKGELDAGKARRIAWLLEG<br>DIVLDRVEKVTVEDYEGYVYDLSVEENENFLAGFGMLYAH<br>NS (SEQ ID NO: 182) |
| Tsp-GT Pol-1 | NSLLPEEWIPLVENGKVRLHRIGEFVDKLMETDSELVKRNG<br>DTEVLEVRGIRALSFDRKSKKARVMPVKAVIRHRYSGDVY<br>EIVLGSGRRITVTEGHSLFAYGDGELREVTGGEIKAGDLLAV<br>PRRVNLPEKKERLNLVELLRRLPEEETGDIILTIPVKGRKNFF<br>KGMLRTLRWISGEEKRPRTARRYLEHLEGLGYVRLKKIGYE<br>VTDREGLERYRKLYERLVEAVRYNGNKREYLVEFNAVRDV<br>IALMPEEELRDWLVGTRNGFRMRPFVEIEEDFAKLLGYYVS<br>EGNARKWRNQKNGWSYTVKLYNENQRVLDDMESLAERFF<br>GRVKRGKNYIEIPRKMAYIIFENLCGTLAENKRVPEAIFTSPE<br>SVRWAFIEGYFIGDGDVHPSKRVRLSTKSELLVNGLVLLLN<br>SLGVSAIKIRHDSGVYRVYVNEELPFTDYRKKKNAYYSHVI<br>PKEILEETFGKVFQRNVSYEKFRELVKSEKLDGEKAKRIEW<br>LLNGDVVLDKVLEVKKRPYEGYVYDLSVEEDENFLAGFGL<br>LYAHNS (SEQ ID NO: 183) |

-continued

| 2. Table 2 | |
|---|---|
| Tth-HB27 DnaE-2 | KCLPARARVVDWCTGRVVRVGEIVRGEAKGVWVVSLDEA RLRLVPRPVVAAFPSGKAQVYALRTATGRVLEATANHPVY TPEGWRPLGTLAPGDYVALPRHLSYRPSLHLEGHELDLLGF ALAEGHLRHPSGVYLYTSSEEELAAMEEALRAFPNTRIRVV WRRGVAHVYVGRVDRRQEAGAVAFLERMGLLGLDAKTK RLPEAVFGLPPEEVARFLGRLWTGDGGVDPKGRLIHYATAS KELAWGVQHLLLRLGLQSRLVEKRFSGGYKGYAVYLLGGL EAARRFAETVGPYLVGKRRQDLEALLASWEKAGRSTGDVL PLAFLEEVRAAVAEVAQGQVADLLREAGLAEGLLCLGRGR RGLSRATVGRLAALTGSLALLRLAEAEVYWDRVEAVEPLG EEEVFDLTVEGTHTFVAEDVIVHNS (SEQ ID NO: 184) |
| Tth-HB8 DnaE-1 | RCLAEGSLVLDAATGQRVPIEKVRPGMEVFSLGPDYRLYRV PVLEVLESGVREVVRLRTRSGRTLVLTPDHPLLTPEGWKPL CDLPLGTPIAVPAELPVAGHLAPPEERVTLLALLLGDGNTKL SGRRGTRPNAFFYSKDPELLAAYRRCAEALGAKVKAYVHP TTGVVTLATLAPRPGAQDPVKRLVVEAGMVAKAEEKRVPE EVFRYRREALALFLGRLFSTDGSVEKKRISYSSASLGLAQDV AHLLLRLGITSQLRSRGPRAHEVLISGREDILRFAELIGPYLL GAKRERLAALEAEARRRLPGQGWHLRLVPPAVAYRISEAK RRSGLSWSEAGRRVAVAGSCLSSGLNLKRPRRYLFRHRLFL LGEAFADPGLEALAEGQVLWDPIVAVEPAGKARTFDLRVPP FANFVSEDLVVHNS (SEQ ID NO: 185) |
| Tth-HB8 DnaE-2 | KCLPARARVVDWCTGRVVRVGEIVRGEAKGVWVVSLDEA RLRLVPRPVVAAFPSGKAQVYALRTATGRVLEATANHPVY TPEGWRPLGTLAPGDYVALPRHLSYRPSLHLEGHELDLLGF ALAEGHLRHPSGVYLYTSSEEELAAMEEALRAFPNTRIRVV WRRGVAHVYVGRVDRRQEAGAVAFLERMGLLGLDAKTK RLPEAVFGLPPEEVARFLGRLWTGDGGVDPKGRLIHYATAS KELAWGVQHLLLRLGLQSRLVEKRFSGGYKGYAVYLLGGL EAARRFAETVGPYLVGKRRQDLEALLASWEKAGRSTRDVL PLAFLEEVRAAVAEVAQGQVADLLREAGLAEGLLCLGRGR RGLSRATVGRLAALTGSLALLRLAEAEVYWDRVEAVEPLG EEEVFDLTVEGTHTFVAEDVIVHNS (SEQ ID NO: 186) |
| Tthi Pol | NSLLPEEWVPVIVGDEVKPVRIGEFVDALMKTDSELVRRDG DTEVLEVKEIRALSFNRKSKKARTMPVKAVIRHRYAGDVY EIVLSSGRRIRVTTGHSLFAYRNGELVEITGGEVKPGDLLAV PKRVSLPERKERLDIVELLLKLPESETEDIVMTIPVKGRKNFF SGMLRTLRWIFGEEKRLRTARRYLEHLERLGYVKLRKIGYE VIDGGGLESYRKLYEKLAQTVRYNGNRREYLVDFNAIRDVI PLMPVEELKEWLIGTRNGFRMRPFIDVNEDFAKLLGYYVSE GNARKWKNHTGGWSYSVKLYNEDESVLDDMERLASKFFG RTRRGKNYVEIPRKMAYIIFEGLCGVLAENKRVPEVVFTSPE NVRWAFLGGYFIGDGDVHPGKRVRLSTKSELLVNGLVLLL NSLGISAIKIRHDSGVHRVYVNEELPFTEYRKKKNVYYSHVI PKEVLEETFRKVFQKNMSREKFRELVESGKLDEERAKRIEW LLDGDIALDKVVEVKREHYDGYVYDLSVEEDENFLAGFGL LYAHNS (SEQ ID NO: 187) |
| Tye RNR-1 | ECYSSDTQVLTYSGWKYFFELTEHDFIFTMNTETKKIELQKP VKFYEFDYNGAMYHFKSKKLDLLVTPNHRMLVQQYSPTSK ENGKLKFIEAEKFNPNTHFIPKHALWEGRIEEYFILPEIKIYQ YINFKKVNSKSESPDILEEEARIYSSQPIEKYEIKVLPPKKIPM NLWLKFFGFWLAEGCTYLRKRQRKGREVPYYEYLVRISQK KSEIAEEFEKVLSQIPFSYNKKFKADLIEFYINDKQLFSYLRK FGKSCDKFIPSEIKNLSKEQLEIIFDWLMKGDGWSGDGNIEY STKSKRLADDIQEIVLKLGMSANIYERKKGNFKWYDVGVSL AKNFRLNSVNKQVTNYAGKVYCVEVPNHTLYVRRNGKAC WCGNS (SEQ ID NO: 188) |
| Tzi Pol | NSILPDEWIPLLINGRLKLVRIGDFVDSAMKELKPMKRDETE VLEVSGIGAISFNRKTKRSETMPVRALLRHRYSGKVYGIKLS SGRKIKVTAGHSLFTFRDGELVEIKGEEIKPGDFIAVPGRINL PERQERINLVEVLLGLPEEETADIVLTIPVKGRRNFFKGMLR TLRWIFGEEKRPGTARRYLEHLQTLGYVRLGKIGYEIVNEE ALRDYRGLYETLTGKVKYNGNKREYLVHFNDLRDIIRLMP EKELKEWKVGTLNGFRMETSIEVKEDFAKLLSYYVSEGYA GKQRSQKNGWNYSVKLYNNDQNVLDDMETLASKFFGKVR RGKNYVEIPRKMAYVLFESLCGTLAENKRVPEIIFTSPESVR WAFLEGCFIGDGDLHPGKGVRLSTKSEELVNGLVILLNSLG VSALRIWLDSGVYRVLVNEELPFLDKGKKKTPYVTSKEIPE EAFGKRFQRNISLEKLREKVEKGEPDAEKVKRVVWLLEGDI VLDRVEEVAVDDYEGYVYDLSVEENENFLAGFGMLYAHN S (SEQ ID NO: 189) |

-continued

| 2. Table 2 | |
|---|---|
| Unc-MetRFS MCM2 | QSYHPLTEILLADGRKIRIGDLFDQTYAKADEIIEGIDCEIVPC EGVSVLSTDMNHITEQRVDRVSRHKAPDHFIKIRYSNDREII VTPEHPVFIVKDGISCIPASAVTIGDPVPAPVEEQTGSKICSLY VTAVEVIPNEGQYRTDYVYDVTVEPYHCFVSQGVILHNS (SEQ ID NO: 190) |

Other suitable inteins are provided in Table 3 below. An intein used in the fusion proteins described herein may comprise an amino acid sequence having at least 80% sequence identity (e.g. at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity) with an amino acid sequence provided in Table 3 (e.g. one of SEQ ID NO: 191-239). The inteins in Table 3 satisfy the following criteria: 1) is from thermophilic organisms, and 2) the +1 position of extein is cysteine (+1C-intein). −1 and +1 extein residues are included for all of them.

3. TABLE 3

| | |
|---|---|
| Aae RIR2 | LCFIEGTEVLTKRGFVDFRELREDDLVAQYDIETGEISWTKP YAYVERDYEGSMYRLKHPKSNWEVVATEGHEFIVRNLKTG KERKEPIEKVKLHPYSAIPVAGRYTGEVEEYDLWELVSGKG ITLKTRSAVKNKLTPIEKLLIVLQADGTIDSKRNGKFTGFQQ LKFFFSKYRKINEFEKILNECAPYGIKWKKYERQDGIAYTVY YPNDLPIKPTKFFDEWVRLDEITEEWIREFVEELVKWDGHIP KDRNKKKVYYYSTKEKRNKDFVQALCALGGMRTVVSRER NPKAKNPVYRIWIYLEDDYINTQTMVKEEFYYKGKVYCVS VPKGNIVVRYKDSVCIAGNC (SEQ ID NO: 191) |
| Ace RIR1 | ACQPYSAPVSTPDGPIPIGKLVDANAVGEKVFDASGVTRIVA TTCNGRKPVLRIRTSGGHVLDVTPDHLVWQVVDQTAGRFV PAGQLRVGDRLEWHDRANSDAMVAAFTADSAAAAQPGQI VDILAIDELGVMPVYDIQTESGEYLSDGIRVHNC (SEQ ID NO: 192) |
| Chy RIR1 | PCVTGDTLVFTDKGLIEARKLEVGMKVWSGDGWNEIKEVI NNGVKPVLKLKLKTGLEIKVTEEHKIFTGEGWKEAKDLKV GDKLYLPVSYPELDFPVKEENDFYEFLGYFLGDGSLSVSNH VSLHVGNDKELALYFKEKVEKYAGAAYLIERDGQYIIDVHR KEFAEKIKKIFGIEITDSKEKDIPSSLLAVNSEAMKALLRGLF SADGSVYDANGSITVALSSTSYPLLRKVQILLLSLGIPSTLTG EKDQDVKIIKGNEYETLPTYRLIISGERASLFFNKIGLIGEKK KKFLELMAGKTTYSTLNNHLYQEIVSIEPAGEEEVFDITAPP KYTWITNGILSLDC (SEQ ID NO: 193) |
| Daud RIR1 | PCVTGDTWVTTGAGPRQVRELVGRPFEAIVNGKAYGTGKD GFFQTGTKPVVKLCTREGYTVRLTADHMILRVTDKTRYRLS QEWVPAADLKAGDQIVLHNHRPLPGWPGALTEGEGYLLGL LVGDGTLKKETAILSTWVKKQAVNGSGAGDGVDSVMQLV LQYTGKMRHRADFTGWDPVKGRNEYRFKSAGIKVLAERM GLGPGRKTATPEIEGASSEGYRGFLRGLFDADGTIIGEQQKG VSIRLTQSNRDLLGIVQRMLARLGIISTIYEGRRPAGLKSLPD GNGGNKEYHIKAQHELVISRDNISVFAERIGFGNSEKAGRLK SLLEAYKRDLNRERFTATVLCVEEDGIEDVYDVQVPGINAF DANGIVAHNC (SEQ ID NO: 194) |
| Dth UDP GD | HCLLGKEKILVKNSKISNVYSLEELFKLESKENKVYKIGDLE VLKTNDLFVNSLNDSNLSSSWMPVSYLFKRKYKGDLVKIIT EDNRKLIVTEKHPMLRLDNGSVEVVEARDLKVGDLLPLFKE NFEEKIEIREVVVDLIKELSEEWENRVRVKIINGSWVNYKAE IYSICKTDRKYDYIKGDYLPLGIFRRLEREKKINIEHDSLILLT GRGPSTAKFPAVVKIDKDLARFIGYYLSEGCATKERGYYRI RLTINKDEKELFSDIESILNKLGLTHSIYLSPKFKAKTIRINSPL LGWLLIDRLRCGKDSYSMRIPDELMSASLDLKEELLKGLFR GDGDIHYRNERRNYIKNGKKYNHRNNSLVIGYFSISDVLFY QIIYLLQEMGIYPSISKNKNHLKISGYDNLKKLTDWFLDEKG RKYSNYFRFSLKKINNKRNNFPIPLVSVKKIEFESVDNIDVYS LEVENTHTFAVGSGIYVHNC (SEQ ID NO: 195) |

3. TABLE 3-continued

| | |
|---|---|
| Mein-ME PEP | TCIEGDAKILTDRGFITMREAYELVKNGEKIRVLGLNAKTLR<br>TEWKEIIDAQKREAKRFEVGVYRKNKNTKDTIKITPDHKFPI<br>IKDGSLKKVPLAEIIENNYSVLSIDYIPMISEKFETLSNIMYLC<br>GAILSDGHVEYQTSKIMPSKILGFVEDNINTIPLYATEEELTD<br>FLAGYVDGDGYLSGKARIEIYENSKHVKKIEGLILSLYRVGI<br>VPKMRIKNNTAVIYFKDNLEKILSKTKRITIEKLNQLKAEVR<br>EDNKLIDISQMFPECKEYDYRGYLYNHYKNRAFIGVEKLYN<br>YLKERADGSLIKKIELIRNSNIYSIRLIKVGEDYGEVYNLTVD<br>ADNEFDHNYIVWTKYYTPIVVFNC (SEQ ID NO: 196) |
| Mja Hyp-1 | HCVPPDTLLILENGFKRIVDIKVGDKVLTHENRFKKVEKVY<br>KRRYIGDIIKIKVRYFPEEIILTPEHPVYAIKTEKRCDGSHGIC<br>KFNCLTQYTNPSCKKRYRKYKREWIIAKDLKVGDVIVYPIP<br>NRVRDIKYLSLDKYLSNIKREFCRSRIPEKIEVSEEFCRLVGY<br>FLSEGYCFRDGIGFALGENEKKIIDDIEYLMKKIFNLKPKIRD<br>DGRSEGIELKYYSRVLRDFFGDMFYCGDEKRAWNKALPNE<br>FLYLPKNKQLQIFIGWWRGDKGVTTSEILMNQLRLISLRLGF<br>IITFSKHVPKNPKIGDREVIKYHARWQGRVSILDEKIVDELK<br>NEDIKLPKKDVRYGWIKGNYLYAPIIRIGREYYDGFVYNLE<br>VEDDSSYVTVSGTLHNC (SEQ ID NO: 197) |
| Mja PEP | TCIEGDAKILTDRGFLKMKEVYKLVKNGEKLKVLGLNAETL<br>KTEWKEIIDAQKREARRYEIGVYRKNKNTKDTIKITPDHKFP<br>VFVNGELSKVQLCDIIDNNLSVLSIDYIPMIEEKYESLAEVM<br>YLGGAVLSDGHIVRRNGKPIRVRFTQKDTEEKKDFIEKVKG<br>DVKLIGGNFIEISNRNNVIEYQTSRKIPSEILGFIEVNINTIPLY<br>ATKDEIADLIAGFVDGDGCLSGKRRVEIYQNSSHIKKIEGLIV<br>GLYRLGIIPRLRYKRSSTATIYFNNNLETILQRTRRIKLDKLK<br>EFKKPVEDKKLIDISQILPELKEFDYKGYLYKTYKEKLFIGIN<br>KLEEYLSKIDKDGIERIKQKIKLLKESDIYSIRIKKVGEDYGE<br>VYNITVKAENEFNHNYVVWTKHYTPIVVFNC (SEQ ID NO:<br>198) |
| Mja RFC-3 | SCLTGDAKITLPDEREIKIEDFIKMFEERKLKHVLNRNGEDL<br>VLAGVKFNSKIVNHKVYRLVLESGREIEATGDHKFLTRDG<br>WKEVYELKEDDEVLVYPALEGVGFEVDERRIIGLNEFYEFL<br>TNYEIKLGYKPLGKAKSYKELITRDKEKILSRVLELSDKYSK<br>SEIRRKIEEEFGIKISLTTIKNLINGKIDGFALKYVRKIKELGW<br>DEITYDDEKAGIFARLLGFIIGDGHLSKSKEGRILITATINELE<br>GIKKDLEKLGIKASNIIEKDIEHKLDGREIKGKTSFIYINNKAF<br>YLLLNFWGVEIGNKTINGYNIPKWIKYGNKFVKREFLRGLF<br>GADGTKPYIKKYNINGIKLGIRVENISKDKTLEFFEEVKKML<br>EEFEVESYIKVSKIDNKNLTELIVKANNKNYLKYLSRISYAY<br>EKDNFARLVGEYLRIKEAYKDIILKEIAENALKEADGEKSLR<br>ELARKYNVPVDFIINQLKGKDIGLPRNFMTFEEFLKEKVVD<br>GKYVSERIIKKECIGYRDVYDITCHKDPSFIANGFVSHNC<br>(SEQ ID NO: 199) |
| Mja r-Gyr | LCLTPDTYVVLGDGRIETIEDIVNAKERNVLSLDLDNLSIKID<br>TAIKFWKLRYNGNLSKITLSNNYELKATPDHCLLVLRDNQL<br>KWIPAKDIKENDYIAMPFNYKVERKPISLLNLLKYLDITDVL<br>IEFDENSTIFEKIAEYIRNNIKTSTKYKYLRNRRVPLKYLIEW<br>NFDLDEIEKEAKYIYKSVAGTKKIPLFKLDERFWYFAGLVL<br>GDGSIQDSKIRIAQTPLKDVKSILDETFPFLHNWISGNQVIISN<br>PIIAEILEKLGMRNGKLNGIIFSLPESYINALIAGYFDTDGCFS<br>LLYDKKAKKHNLRMVLTSKRRDVLEKIGIYLNSIGILNTLH<br>KSREVYSLIISNKSLETFKEKIAKYLKIRKEAFINGYKTYKKE<br>HEERFECDLLPVKEVFKKLTFEKGRKEILKDSKIHIENWYKE<br>KTNNIPREKLKTVLRYANNSEHKEFLEKIVNGDISFVRVKK<br>VENIPYDGYVYDLSIKHNQNFISNGVISHNC (SEQ ID NO:<br>200) |
| Mja rPol A′ | VCVDGDTTVLLDGKLIKIKDLEDKWKDVKVLTSDDLNPKL<br>TSLSKYWKLNADEYGKKIYKIKTELGREIIATEDHPFYTTNG<br>RKRCGELKVGDEVIIYPNDFPMFEDDNRVIVDEEKIKKVINN<br>IGGTYKNKIINELKDRKLIPLTYNDQKASILARIVGHVMGDG<br>SLIINNKNSRVVFRGDIEDLKTIKEDLKELGYDGEEIKLHEGE<br>TEITDYNGKKRIIKGKGYSFEVRKKSLCILLKALGCVGGDKT<br>KKMYGIPNWIKTAPKYIKKEFLSAYFGSELTTPKIRNHGTSF<br>KELSFKIAKIEEIFDEDRFIKDIKEMLKEFGIELKVRVEEGNL<br>RKDGYKTKVYVASIYNHKEFFGRIGYTYANKKETLARYAY<br>EYLLTKEKYLKDRNIKKLENNTKFITFDKFIKEKCLKNGFVK<br>EKIVSIEETKVDYVYDITTISETHNFIANGFLTGNC (SEQ ID<br>NO: 201) |
| Mja RtcB (alternative name: Mja Hyp-2) | NCLTSNSKILTDDGYYIKLEKLKEKLDLHIKIYNTEEGEKSS<br>NILFVSERYADEKIIRIKTESGRVLEGSKDHPVLTLNGYVPM<br>GMLKEGDDVIVYPYEGVEYEEPSDEIILDEDDFAEYDKQIIK<br>YLKDRGLLPLRMDNKNIGIIARLLGFAFGDGSIVKENGDRER<br>LYVAFYGKRETLIKIREDLEKLGIKASRIYSRKREVEIRNAY |

3. TABLE 3-continued

| | |
|---|---|
| | GDEYTSLCEDNSIKITSKAFALFMHKLGMPIGKKTEQIYKIPE<br>WIKKAPKWVKRNFLAGLFGADGSRAVFKNYTPLPINLTMS<br>KSEELKENILEFLNEIKLLLAEFDIESMIYEIKSLDGRVSYRLA<br>IVGEESIKNFLGRINYEYSGEKKVIGLLAYEYLRRKDIAKEIR<br>KKCIKRAKELYKKGVTVSEMLKMDEFRNEFISKRLIERAVY<br>ENLDEDDVRISTKFPKFEEFIEKYGVIGGFVIDKIKEIEEISYD<br>SKLYDVGIVSKEHNFIANSIVVHNC (SEQ ID NO: 202) |
| Mja UDP GD | SCFHPDEVLFIDRGRGLECITFKELFELEDKDNVKILSFDGEK<br>LSLKKLKLASKRYYNDDLITLRFNLGREIKITKDHPVVILED<br>GELKIKLTSDVKEGDKVILPYGNFGEEREIEIDILEELSKTDLI<br>EKVWIHNKDLATNEFNIIKPYLSNKYPHDVKRNGTIRAKDIL<br>PIKEILDKYGSKNRLFTAKSKSTTIPYKIKIDKDFARLIGYYLS<br>EGWISKDYGRNGVVRKRIGLCFGIHEEEYINDVKNILNKLGI<br>KYIEKIKDGSHSILISSKILAYVFENILNCGINCYNKNIPPQMF<br>NAKEEIKWEFLKGLFRGDGGIVRLNNNKNLNIEFATVSKKM<br>AHSLLILLQLLGIVASVKKCYNNKSTTMAYIIRINGLEQVKKI<br>GELFGKKWENYKDIAESYKRNIEPLGYKKSDNFAILEVKEII<br>KEHYSGYVYSVETENSLLITSYGILIHNC (SEQ ID NO: 203) |
| Mka RtcB | NCLAPGTKILTEHGCWVKVEDLPKMLTDQKLKVYDVDEG<br>REDDSEIKFVMERGIEEDERAVVLVTESGLTIEGSEDHPVLT<br>PEGYVELGEIEEGDLVVVYPFEGVEYEEKEGTILDESDFEDV<br>DPQVLRYLEERDLIPLRWSDPKVGTLARILGFAMGDGHLGE<br>QAGRLTLSFYGDERTLRELKRDLESLGVKANLHVRKRRYEI<br>ETASGRYEGEATSVELRVASRSFALLMEKLGMPRGRKVETP<br>YKVPDWIKEAPLWVKRNFLAGLFAADGSVVKFKRYTPLPI<br>NLTQAKVEELEENLREFMNDVAKLLREFGIETTLYEVKSKK<br>NVVYKLAIVGEENIKRFLGKVGYEYDPEKKVEGLAAYAYL<br>KLKERVKKDRKEAAETAAEVYEETGSITKAHEAVADVVNR<br>RFVERVVYDGGISSVRVPEDFPTFERFKEERVLAGGFVIEEV<br>VEVKGVEPEYDRFYDIGVCHGAHNFIADGVVVHNC (SEQ<br>ID NO: 204) |
| Mka VatB | YCFAPGTRVITASGDVVEIDEIVERAAETAVDGGLREGSTEV<br>TVGVTNVRTLAAWDGDLTSNDVVAVEKIEAPSRAVRVRTR<br>SGAELVVSEDHKFLVDTEDGPRMVEASELKSGDELYSVREL<br>RVSEKVPTYLELLLEAEDKFYVHPTEEFEEAVAERYGSLAE<br>ACREKELPYRAREAKERRYYELSEFARLATAVIESVDEATE<br>YIDYVTAGGRKRVKFSSPRPGKEVMYVAGLIASDGSVDTER<br>GFVMFSNTERELLSAFEEIVTEEFGVDASKTENQNGVTMLR<br>VNSRVLARVFERLADPKTVLKMPRELVAAYLAGYVDGDG<br>HLKDGKIVITTADRERAGDLQLLLKRLGVPSVLRERDGAYD<br>VVVTGHDAAELAEELPLRHPKKAEAAASMSSGRRSSRFDR<br>VSRRFGRLLREVRRKYGVRASDLGSSSTISQIESGERRATRR<br>LALEIVERLEEVVGDVEEVRELRELAEGNYVLDEVVEVETV<br>EYEHEYLYDVTVVPDHTLVVENGIITSNC (SEQ ID NO: 205) |
| Mvu-M7 UDP GD | SCFHPDEVLFIDRGRGLECITFKELFELEDKDDIKVLSFDGEK<br>LSLKKLKLASKRYYNDDLITLRFNLGREIKITKDHPVVILED<br>RNLKVKLAEDVKEGDKVILPYGNFGEEQEIEIDILEELSKTD<br>LIEKVWIHNKDLVINEFNIIKLYLSNKYPHDVKRNGTIRSKDI<br>LLIKEILDKYGSKNRLFTARSKSTTIPYKIKIDKDFARLMGYY<br>LSEGWISKDYGRNGVVRKRIGLCFGIHEEEYINDVKNILNKL<br>GIKYIEKIKDGSHSIIISSKILAYVFENILNCGINCYNKNIPPQIF<br>NSKEEIKWEFLKGLFRGDGGIVRLNNDKNLNIEFATVSKKM<br>AHSLLILLQSLGIVASVKKCYNNKSTTMAYIIRINGLEQVKKI<br>GELFGRKWENYKDIVENYKRNIKPLGYSKSDNFAILEVKEII<br>KEHYSGYVYSVETENSLLITSYGILIHNC (SEQ ID NO: 206) |
| Nma-ATCC43099 PolB-1 | NCLPADSDVLMADGTEKEIQEIEIGDSVVGSDSQQTSVAEV<br>TNKWESEKEIREFSLADGTSLRSSADHRIMVGGDDAVDWK<br>EGSEIESGDYVLKPRRLSVEETATPTLSDLIPIENQRYADKQS<br>VSEFKTDLPYGAVSELADQFDVTTGTLHHPHTSVWTPKRCR<br>DAASQYDVPVPDGGVEYRGTGVALERKITPEELYYAGLILT<br>DGSMSTDDGVRFYNTREELHRQFPGENHLEPDGKGCYKQN<br>VLDYATMYAFHGLGIPFGNKNDGPVDLSTIYEMPSEYIGRF<br>LAGAIDGDGNIAQSGITVAAENRSIGTWYVKLFKRLGIYAQ<br>QRENVVRIPDAKRDIDRLKDCVLPYMSHSEKKDALTEFEGG<br>KSGQTENIPYALFEADVGSDAKRIGNDKHRRGINLKRHETH<br>SEEWEEYVFVEVTDVSVTGTETTYDIETTTHNFIAEGCLVHN<br>C (SEQ ID NO: 207) |
| Pab KlbA | GALYYFSEIQLPNGKEFIGKLVDELFEKYHDKIGKYKDMEY<br>VELNEEDTFEVISIGPDLSARRHKVTHVWRRKVKDGEKLVK<br>IRTASGKELVLTQDHPVFVLLGRDVARRDAGNVKVGDEIA<br>VLNTRPDFSVLSPPAMPELLSEPFNYELSSIGDVAWDEVVEV<br>DEIDAKGLGVEYLYDLTVDINHNYVANGIVVSNC (SEQ ID<br>NO: 208) |

3. TABLE 3-continued

| | |
|---|---|
| Pab Moaa | YCFPPTEEAVFKFGDKVKIATFEEVAKNFKFEHKVEIDGFKG<br>EYSIPNDLYVLTFNDGKAEWTRVTKFLRRKHEGKIRVIKTK<br>TGRTIRTTPEHKFFVYKDGELVKKRADELEPGDELVLLWRF<br>ESEETLTEINLLEAFKDLPQEEKEKVYVRGIKDLDLTPLKEK<br>YGDKVYYWARQDSMPLSVFYELNVDLDKEFRLGRDATTY<br>ELPSKLKITPSLAKLIGYFVSDGNYSDKDLRITVGHEDVEKEI<br>VNILEELGLPYSFLEWEGKTKQIVIGSRLLRLVFKHVFKIPEG<br>APNKRLPEGFLSFPFEAKVALLSGLFNGDGYVVRGEHHLSI<br>GYASTSKGLIRDILYLLASLGIFARVYRVPKEKMKGANHDL<br>YKLYIAGTDLVRLVELLELREGHREKLGEIGNRKPARVKKI<br>ADFYIDVVDEVSEEEYSGYVYDLEVENEGHSFVAADGILVS<br>NC (SEQ ID NO: 209) |
| Pab RFC-2 | SCVTGDTKVYTPDEREVKIRDFMNYFENGLIKEVSNRIGRD<br>TVIAAVSFNSRIVGHPVYRLTLESGRIIEATGDHMFLTPEGW<br>KQTYDIKEGSEVLVKPTLEGTPYEPDPRVIIDIKEFYNFLEKI<br>EREHNLKPLKEAKTFRELITKDKEKILRRALELRAEIENGLT<br>KREAEILELISADTWIPRAELEKKARISRTRLNQILQRLEKKG<br>YIERRIEGRKQFVRKIRNGKILRNAMDIKRILEEEFGIKISYTT<br>VKKLLSGNVDGMAYRILKEVKEKWLVRYDDEKAGILARV<br>VGFILGDGHLARNGRIWFNSSKEELEMLANDLRKLGLKPSE<br>IIERDSSSEIQGRKVKGRIYMLYVDNAAFHALLRFWKVEVG<br>NKTKKGYTVPEWIKKGNLFVKREFLRGLFGADGTKPCGKR<br>YNFNGIKLEIRAKKESLERTVEFLNDVADLLREFDVDSKITV<br>SPTKEGFIIRLIVTPNDANYLNFLTRVGYAYAKDTYARLVGE<br>YIRIKLAYKNIILPGIAEKAIELATVTNSTYAAKVLGVSRDFV<br>VNRLKGTQIGITRDFMTFEEFMKERVLNGYVIEKVIKKEKL<br>GYLDVYDVTCARDHSFISNGLVSHNC (SEQ ID NO: 210) |
| Pab RIR1-3 | PCVVGETRILTPEGYIKAEELFKLAKERGKMEAIAVEGIAEG<br>GEPYAYSLEILLPGDKQVKYETVHGNAVEVADPVSVPAYV<br>WKVGMKEVARVRTKEGYEITATLDHKLMTPEGWKEIKDL<br>KPGDKILLPRFEVEEDFGSESIGEDLAFVLGWFIGDGYLNVK<br>DKRAWFYFNAEKEEEIAWKIREILAKRFEIKAEPHRYGNQIK<br>LGVRGKAYEWLESIVKTNEKRIPEIVYRLKPNEIASFLRGLFS<br>ADGYVDNDMAIRLTSKSRELLREVQDLLLLFGILSKIYERPY<br>KREFKYTTKDGEERTYTTEGYYELVIANYSRKIFAERIGLEG<br>YKMEKLSLEKIKVDEPIVTVESVEILGKKLVYDFTVPEHHM<br>YISNGFMSHNC (SEQ ID NO: 211) |
| Pab RtcB (alternative name: Pab Hyp-2) | NCLAPGSKVLTEHGYWLKVEELPEKFKLQGVKVYNLDEGH<br>NDTSNVAFVAEREVETGEMAVRVTTESGRIIEGSEDHPVLTP<br>EGYVYLGNLKEGNLVIVYPFEGVEYEERKGVILDEDAFKDE<br>DPQVLSFLREKGLVPLRWDDPRIGTIARILGFAFGDGYLGE<br>MGGRLTLTFYGKEETLRELKKDLERLGISANLYVRESIETTS<br>GHSEGKSLSIELRVTSRSFALFLEKLGMPRGKKTEKAYRVP<br>GWILEAPLWVKRNFLAGLFAADGSIVEFKGNTPLPINLTQSK<br>SDELAENLVEFLGDVAKLLAEFGIETTLYEVKSKKGVTYRL<br>SIVGEDSIRTFVERINYEYDPEKKVKGLIAAAYLKLKERIVK<br>EAHEAVKDDFPTFEEFAKERGYEGGFVAEKVVKVERVKPE<br>YTKFYDIGVYHEAHNFIANGIVVHNC (SEQ ID NO: 212) |
| Par RIR1 | PCVTGDTRVLTRDGYLKISEVYKRAKERGELFLISEGVEKD<br>GDPKGYAVHVVVPLLQVKTDGRTEQVAQLVKSGVLKVGT<br>KDVYLVATKEGFEIKATGDHKLLVVNSLGEYEWRRVDELR<br>PGDKLVVSMVDISRADIGEDTMPASVAYLLGRVVGDGSIIV<br>DKHNRPHIYVYFSKEELEEALALIDMLKAEFGSDISYTLSEK<br>RTEIALEISGTVARAITSMVPELIHLKRDKLVPEVIFESKPGII<br>RWFLRGLFDADGTIDRDYAIRLTSTSKRLLREVQQLLLLFGI<br>YSVIYKRRRKGGVFKYVTKSGEERVYKSSEVYYELVIKNES<br>RCRFMEKIGLSPRKSAKISLKKCKREKPFATVASVEYIGKEV<br>VYDFGVPDYHRYIAEGIVSHNC (SEQ ID NO: 213) |
| Pfu KlbA | GALYDFSVIQLSNGRFVLIGDLVEELFKKYAEKIKTYKDLEY<br>IELNEEDRFEVVSVSPDIKANKHVVSRVWRRKVREGEKLIRI<br>KTRTGNEIILTRNHPLFAFSNGDVVRKEAEKLKVGDRVAVM<br>MRPPSPPQTKAVVDPAIYVKISDYYLVPNGKGMIKVPNDGI<br>PPEKAQYLLSVNSYPVKLVREVDEKLSYLAGVILGDGYISS<br>NGYYISATFDDEAYMDAFVSVVSDFIPNYVPSIRKNGDYTIV<br>TVGSKIFAEMLSRIFGIPRGRKSMWDIPDVVLSNDDLMRYFI<br>AGLFDADGYVDENGPSIVLVTKSETVARKIWYVLQRIGIIST<br>VSRVKSRGFKEGELFRVIISGVEDLAKFAKFIPLRHSRKRAK<br>LMEILRTKKPYRGRRTYRVPISSDMIAPLRQMLGLTVAELSK<br>LASYYAGEKVSESLIRHIEKGRVKEIRRSTLKGIALALQQIAK<br>DVGNEEAWVRAKRLQIIAEGDVYWDEVVSVEEVDPKELGI<br>EYVYDLTVEDDHNYVANGILVSNC (SEQ ID NO: 214) |
| Pfu RtcB (alternative name: Pfu Hyp-2) | NCLAPGTKVLTEHGYWLKIEEMPEKFKLQRLRLYNIEEGHN<br>DFSRVAFVAERNIEKDETAIRIVTETGTLIEGSEDHPVLTPQG<br>YVYLKNIKEGDYVIVYPFEGVPYEEKKGIIIDESAFEGEDPQV |

3. TABLE 3-continued

| | |
|---|---|
| | IKFLKERNLLPLRWEDPKIGTLARILGFALGDGHLGEMGGR LVLAFYGREETLRELKKDLESLGIKANLYVREKNYRIKTES GEYSGKTVLAELRVSSRSFALLLEKLGMPRGEKTKKAYRIP VWIMEAPLWVKRNFLAGFFGADGSIVEFKGTTPLPIHLTQA KDVALEENLKEFLYDISRILEEFGVKTTIYKVNSKKSVTYRL SIVGEENIRNFLGKINYEYDPKKKAKGLIAYAYLKFKESVKK ERRKAMEISKKIYEETGNIDRAYKAVKDIVNRRFVERTIYEG ERNPRVPKNFLTFEEFAKERGYEGGFVAEKVVKVERIKPEY DRFYDIGVYHEAHNFIANGIVVHNC (SEQ ID NO: 215) |
| Pfu TopA | FCLHPDTLILTSQGVRKIKELSREGEVFALDFNLKLSKAKYR LLERDADEQMYKVTLLDGTELYLTADHPVLVYREGNLAFV PADKLRETDHVVLVLNKSARDNYGFLDLLLEITDSQEDYAI LENGETLSLHSLKMLVERGEIKDIAVVGFSHNNFGKVMLRD ELWYLIGYLAGKGGEIKGNGVVISSRTKEIVGLTKSLNIDLIE TEEGIVLSNKSFVRLLHLIHYTPRVPEVYGIINNTEWLKAFL AGYYDATLLEGLTLEALYKIKVYLQLLGIRAKIEDNKLKVH LEDLQRFRELLGKFSRRKLYVETSQVPVFTDFDERSYDFPRI LGGDIYIIGIKSIEKFHYKGKVYDLVVENYHNFIANGIAVHN C (SEQ ID NO: 216) |
| Pho KlbA | GALYDFSIIQLSNGRFVLIGDLVEELFKKYSDKIERYKDLEYI ELNDEDRFEVVSVGPDLKANKHIVSRVWRRRVREGEKLIRI KTRTGNEVILTRSHPLFAFSNGDVVRKEAGNLKVGDRVAV MMNPPKPPQTKAVVDLSIYAKISDYYLVPNGKGMIKVPNK GLPPEKAQYLVSVNSHPVKLVREVDEKLSYLAGVILGDGYI SSNGYYISATFDDEDYMEAFVSVISDFIPNYIPNVKENGKYM VVTVGSKIFAEMLSRIFGIPKGRKLEWDVPDIVLSNDDLMR YFIAGLFDADGYVDENSIILVTKSENVARKIWYALQRLGIIST VSRVKNKGFKEGEIFRVIISGVDDLAKFARSIPLHHSRKRAK LMEVLKTKKTHRGRRAYRVPISAEMIAPLRQMLGLTVSELS KLASHYAGEKVSESLIRHVEKGRVKEIRRSTLRGIALALQQV AKDVGDEEAWVKARRLQLIAEGDVYWDEVVSVEEVDPKE LGIEYVYDLTVEDDHNYVANGILVSNC (SEQ ID NO: 217) |
| Pho r-Gyr | LCVTPDTLVSLSDGRIIEIREAVENSEESLLGINGLKPKEAKA LKFWEIDWDGPIKVIKLKNGHEIKATPDHGLLVMRDGKIGW VSAKNIREGDYVAFIYNLGHRGGKKYTLPQLLKELGISEYE NSSSQELNNREQEMDSKQISIELDERFWYIFGVILGKGTLKG DKVVIFQKDVKPVIEEALPFVRIFESADHIGFSHLILAEVFRR LGVGEGKLHSLVFGLREEYINAMIAGYFDASGTFLRRAVLT SKRGDILRMLSVYLYQIGIVNNLRRDEHAGVWELIISDLEKF REKIYPYLRIKKSQFDKVYSISKNEGDFLPVASIFRKLKFRDG FKNRILDEEIPRDEVAKVLEYAEDSPEKEFLNSLVEARVTW VRVEKIEERHYTGKLYDFTTTTENFISNGIVSHNC (SEQ ID NO: 218) |
| Pho RIR1 | PCVVGDTRILTPEGYLKIEDLFRMAKERNNGEKVVAVEGIA EGGEEFAYPVAILLPNEEEKEVIYETVHGKQLAIADPIEVKA YVWKVGKKKVARIKTKEGYEIIATLDHKIMTKDGWKAVED LKEGDLIVLPRFEVEDNFGSESIGEDLAFVLGWLIGDGYINT DDKRVWFYFNAEKEEEIAQKISEILKKRFNSKAEPHRYGSEI KLGVRGEAYKFFEKIVKTNDKRVPEIVYHLKPNEIRAFLRGL FTADGYVDNDGAIRLTSKSRELLRDVQDLLLLFGIISKIYERP YKGTFEYTTKEGEKKVYTAQGYYELVIANYSRKLFAEKIGF EGEKQKKIKLNKTKIDEPY ARVESVEIIGEEIVYDLTVPGIHS YISNGFISHNC (SEQ ID NO: 219) |
| Pho RtcB (alternative name: Pho Hyp-2) | NCLAPGTRVLTEHGYWLKIEEMPEKFKLQRLRVYNIEEGHN DFSKVVFVAERVGSEEKAIRIVTESGKVIEGSEDHPVLTPE GYVYLRNVKEGDYILVYPFEGVPYEEKKGVILDESAFEGED PQVVKFLRERNLIPLQWKDPKVGILARILGFALANGYISEND NLTFHGKEEVLREVRKDLEELGIEAIVAEEDKLKVTSREFAF LLEKLGMAHDSIPEWIIEGPLWIKRNFLAGLFGANGSIVEFK GDVPLPITLTHSRELLNDVSRILEGFKVRAKIKMGKNGSYQL VIEDEDSIRNFLGRINYEYDPEKKARGLIAYAYLKFKELMKG NLMTFEEFARDRGYEGGFVAEKVIEVKSVKPEYDKFYDIGV YHSAHNFIANGIVVHNC (SEQ ID NO: 220) |
| Pma-ExH1 DnaE | LCLTGDTLITMADGSRKTIKEIVENDLIDEEILTLDLSDNGLK KGKITHCFDNGIKDVYKITLQNGLEIKATADHKFLTPFGWK TVRELQAEKDLLAVPVNVDVEGEESDEDKLRVLAYLLADG YLAKSSISFVNKDKTLIEAFKVSVERAFDNVSFKEFLRARDV WNIYIVSKERNRYHSNPLINWFKELGLFHKKSEEKFIPEFVF KLNKESISKFLAYYWDCDGYIGEKLAHIKTISKDLAYGLYY LLLRLGIKANIYKSYYDDKTSYQVTVYDLKNFKKYILPHMI SQKARNLTREVSDNSFYLKDIALEKVKAFCEENGISQREFSR LTGIQRNNFFNGKQQFIKSSVIEKIAPVIEDEELLKLMDGDIG FVPIREIEYAGKEHVYDIEVEGTHNFIANNIISHNC (SEQ ID NO: 221) |

3. TABLE 3-continued

| | |
|---|---|
| Taq-Y51MC23 RIR1 | PCFVGSTRIPTEFGLVPIEELAKKGESFFLVTDRRAPYGGLGL PQTAQGTVVRKAARAFYTGVKPVVRLTTREGLELTLTPDH LLLTPEGYREAGSLKPGDRILVQSGEGLFPKEEALPAAVLEV VQERVATAGGRGRADIQAQYSHLPTRWSRELGVALGWLL GDGYLREDGVGFYFSRQDFAQVAWLPDLLRDWFGGGSLQ DTHSNTYHLHFKRIPAEFFQALGVKPAKATEKRVPESLFRAP REAVVGFLQGLFSADGSVQINPGKQDATVRLASSSKGLLQD VQLLLLNLGIYGRIHKRREAGQKELPDGRGGLKAYPVAAQ YELILGAENRDLFAEIVGFLQEEKQAKLLAFLQDRPKGSYH KPFLATVVGVEPAGEAPVYDLTEPVTHSLIANGIVAHNC (SEQ ID NO: 222) |
| Tel DnaE | YCLSGETAVMTVEYGAVPIRRLVQERLSCHVYSLDGQGHL YTQPIAQWHFQGFRPVYEYQLEDGSTICATPDHRFMTTRGQ MLPIEQIFQEGLELWQVAIAPRQALLQGLKPAVQMSGMKIV GRRLMGWQAVYDIGLAADHNFVLANGAIAANC (SEQ ID NO: 223) |
| Tko KlbA | GALYDFSVIQLSNGKFVLIGDVVEELFNKYSDRIKTYKDLEY IELDPEDQFEVVSVGPNLKAGKHTVTAVWRRKVRNGEKLI RIRTRTGNEVILTKTHPFFVFSDGDVVRKEAEKVRPGDRVA VMMRPPKAPQSPAVVPVEVYAGISDYYLVPNGNGMKKVP NRGVPPEDAEYLLSRNSKPVKLVREVGTSLAYVAGVILGDG YLSSDGYNLSVTFDDPDYMNSFTSAMSEFLPESAPRIKDNG TSTVVTYGSRIFNEMLSRIFGIPRGKKSSIWDVPDVVLTNDD LMRYFIAGLFDADGSVDETGPAVILTTKSESAARKIWYALQ RLGIISTVSRVRNRGFKEGHIFRVIISSVEDLKKFDALIPLSHS RKREKLKAILKEKRPYRGRYTYRVPISPEMIKPLRTRLNLTV AELSKLASKYAGETITESLIRHVEKGRTSEIRRSALKGIALAL QRIAQDIGDEDAWVMAKRLELIADGDVYWDRVVEVEEVD PEEIGIEYLYDLTVDEDHNYVANGILLSNC (SEQ ID NO: 224) |
| Tko r-Gyr | LCVTPDTLVSLADGRIMEIKDAVEKSEGNLLSVNGLKPKEA KALKFWEIDWNGPLKVIKLKNGHEIKATPDHGLLVMREGK LGWVSAKNVREGDYVAFAYNTGHRGRDEYTLLKLMIKLGI TDVMVELDEEYFNEKVAPIVRERISTSTKYKYLRRRVLPLY LLQEWGLDDYEAHVKSLYRQRAGSKPIPNFKLDGRFWYVF GLVLGDGTLRDSKVLISQTPLKDVKSVLEDVFPFLRVFETTN QVGFSNSIIAEVFRRLGARKGKLHPLVFGLREEYINAMIAGY FDTDGTFSILNDRKGPNFRGILTSKRGDVLRMLSVYLYQIGI MNYLRRDERTGVWDLIISNRSLEKFREKIYPYLRIRRAQFDE AYSVYRASRRAFEGDLLPVAPVFGKLKFKNGTKNRILKETG IDVWNWLKRPEGEIPRDKLSKVLEYAEESPEKEFLKSLVEA GVTWVKVKGVEEELYTGKLYDFTTTTENFLSNGAVSHNC (SEQ ID NO: 225) |
| Tko RIR1-2 | PCVVGDTRVLTPEGYIKAEELFSLAKERGKKEAVAVEGIAE EGEPYAYSVEVLLPGEEEVKYETVHGKALAIADPVAVPAY VWKVGKKKVARVRTKQGYEITATLDHRLMTSEGWKEVGE LKPGDEILLPRFEIEEDFGSESIGEDLAFVLGWFIGDGYLNVN DKRAWFYFNAEKEEDIAWKIREILAKHFGIKAEPHRYGNQI KLGVRGEAYRWLESIMGSNEKRVPEIIYRLKPREIAAFLRGL FSADGYVDNDNAVRLTSKDRGLLRDVQDLLLLFGILSKIYE RPYSSEFKYTTKDGEERTYRAEGYYELVIANYSRKLFAEKIG FEGYKMEKLSLQKTKIDEPVVTVESVEVLGEEIVYDFTVPE HHSYISNGFMSHNC (SEQ ID NO: 226) |
| Tko TopA | YCLHPDSLIPTPQGVKRIKELPEKGEVFALDFDLKLSRARYR LLERDADEPMYKVTLSDRTELYLTADHPVLVYRDDQLIFVP AEELRENDQVVLFINRSEYSPRTESPTLLGFLLENATSMKDY ILYDPEFGGVLRNRIKDAGLKTEILWRFRIREPTYYKYLRGK MPVPIVRFLLEEGVVSIEELREVFRGFSYSTSLTPISFEFSEEF WYLFGLVAGDGHLAKKGAITIPAKDRTEDTVKAVKEIANSL QVPFAFDEKYKMIILRSKSLTRLFELLGCPYGNKTEIFRIPGEI MAKPEWMAAFLAGYYDADGHIGTKPTGGKKSHSPQIVLTS KNRMAIYTVKQMWQLLGVGTYLWEKKDRNGNFMAYELK VYSRDAWRFYEVMKNHLRIKRKDLEHVKEVAIRKRKAYSH HYSVLNVKSWEGKIKSSNVLWKKFDMSNQTAHGRGISLDK LQRIVDYLTDTDLRRIAMGDVYVLGIRSIEKFHYRGKVYDL VVDQYHNFIANGVVVHNC (SEQ ID NO: 227) |
| Tli KlbA | GALYDFSVIQLSNGKFVLIGDLVEELFKKYSDRIETYKDLEY IVLDEKDRFEVVSVGPDLKAGKHIVSRVWRRKVREGERLM RIKTRTGNEVILTKTHPFFVFSKGDVVRKEAEKLKVGDRVA VMMNPPKPPQRRAIVDPSIYVKISDYYLVPNGKGMVKIPNE GLPPEKVQYLSSVNSHHVKLVREVNEKLSYIAGVILGDGYIS SGGYYISATFDDEDYMEAFVTAVSKFVPNYVPRMKNDGKS TVVTVGSKIFAEMLSRIFGIPKGKKSGIWDVPDVVLSNDEL |

3. TABLE 3-continued

| | |
|---|---|
| | MRYFIAGLFDADGYVDKNGPSIILATKSENAARKIWYALQR LGIISTVSRVKNRGFKEGEIFRVIISGVEDLTKFAKFIPLCHSR KRAKLMEILNTKKAYRGRKTYRVPISSEMITPIRRRLGLTIA ELSKLASYYAGEKVSEGLIRHIEKGRVREIRRSALKGIALAL QQVAKDIGDKEAWVMGKRLQLLAEGDVYWDEVVSVEEV DPRELGIEYLYDLTVEDDHNYVANGILVSNC (SEQ ID NO: 228) |
| Tli MCM-2 | ACLHPDSRVLVNGKYLPIKELFNEAKSYKAKSNGEIVDIQE DTFEVVSLDLERMKTGNSLATIIRRKQWKGELVKLKFRSGN ELLLTPDHWLIDGKTLEWKEAGEFKPGDTVVAPLKLPEVKE KIYILDILPENWRVKLTKEEKEELRKEVLRRFKSIAEFNRHY GISKDFLSGRGAIKVGKFRKILKDFGIYEKWKKRHLAYGPY SRREKLKVAYITPEMAYFFGFLYGDGWIQRIGDRVTLRITQS LVNEKQLKRLRESFALFYPKKLREYRRTTSSILAGNKISSESI TFSVNSPLLGYIYEYLTKDNLTNLFGLDDEALKAFVAGALD SDGCVSIKRSDKGEVVHVEFLLSNDIRKDNAFAMLLRRFDV YARIVRDKRENVNRIQITSREDVKNLLEAVKSYSIKVKEIPE VKRLISPKSDKLPSEPVKEIARRIREEIPASILLEKGLWSVIYE YSKGVRVPTRKQIHKLLERLSDYLSPEIKFKLEILARRDYFL DEIVEVERIPYEGHVYDLYVPVYHNFVAEGIIVHNC (SEQ ID NO: 229) |
| Tli RFC-3 | SCVTGDTRIYTPDEREVKIKDFLKFYERGLVREVSNRNGRD TVIAAVAFNSKIIGHPVFRLTLESGRVIEATGDHMFLTPAGW VQTYDLKEGSEVLVKPTLEGTPYEVNPEPIVDLRDFYEFAN KLELERGRKPLGEARNFRELTTKDKEKILARALELKAEMEK GLTEREAEILQEISTEWTSREEIQKKVGLSRARLNQLLKNLE EKGYVERRMEGKRQFVRKLRDGVPLRNTADVKRILEKELG IKISYTAVKRLLAGELDGPAYNLLRELKKRWLVRYDDERA GILARVLGFLLGDGHLAKGGTRVWFNSSREELEALAEDLRR LGLKPSEIIERESSSEIGGRKVKGKIHMLYVDNRALHALMRF WGVEAGNKTKKGYRVPEWIRKGNLFVKREFLRGLFAADG TKPYSEKYNFNGIKLEMRTSSESLEETTEFFNDLAELLREFE VDSKVIVSPIGDGFIVRLVVTPNESNYLKFLTRVGYAYVKD KYARLVGEYLRMKLTYKEIILPQIAEKAVELAAKTNPTQAA KLLGVKRDFVVNRLNGVPIGLTRDFMTFEDFRRERVTGDY VVEKVIKKEELGYLDVYDVTCASDHSFISNGLVSHNC (SEQ ID NO: 230) |
| Tli RIR1 | PCVVGDTRVLTPEGYLKIEELFRIAKERNEEKVVAVEGIAEE GEEFAYPITILLPNEEEKEVIYETAHGKQLAVADPIETKAYV WKVGRKKVARVKTKEGYEITATLDHKIMTKDGWKAVEEL KEGDLIALPRFEIEDDFGSESIGEDLAFALGWFIGDGYINTND KRVWFYFNAEKEEEMAHKISEILKKHFNSKAEPHKYGSEIK LGVRGEAYRFFEKIVKTNEKRVPEIVYRLKPNEIRAFLRGLF TADGYVDNDSAIRLTSRDRELLRDVQDLLLLFGILSKIYERP YKGTFEYTTKDGEKKIYEAQGYYELVIANYSRKLFAEKIGF EGEKQEKIRLNKTKIDEPYARVDSVEFIGEEIVYDLTVPEIHS YVSNGFMSHNC (SEQ ID NO: 231) |
| Tli TopA | YCLHPDSLIPTPQGIKRIRELPKEGEVFALDFDLKLSKAGYK LLERDADEPMYKVTLTDRTELYLTADHPVLVYRDDKLMFV PAEELREDDQVVLLINRDKPPENEEPPTLLDFLLESAVSMKD YIIYDREFGEIIKKRVKSASLKTEILRKFRIKEPTYYKYLRGKI PVPLVKFLLQRGIISDSELRRTFKGFSYSTATTPIAFEFSEDFW YLFGLVVGDGHLNRRGEITISAKERTKDTIEAVKSVTNSLGL SFAFNPKYRIIAINNKSLTRLLELLGCPSGNKTEIFRIPGIIMA RPEWMAAFLAGYYDADSHIGTKQTGSKKSLSPQIVLTSKNR EAIYTVKLMWQFLGVGTYLWEKKDKNGGIIAYELKIYSRD AQRFYEIMKDRLRIKRRDLESVKDTAIRERKPYSHHYSLIKV KSWEGKILSTNALWKSFDMSNQTAHGRRISLDKLRSIVRYLI DQDLRRIATGDVYILGIKSIEKFHYRGKVYDLVVNTYHNFIA NGVVVHNC (SEQ ID NO: 232) |
| Tsp AM4 RtcB | NCLAPGSKVLTEHGYWIKVEEMPEKFKLQGLRVYDVDEGH NDFSQVAFVAERDVEENELAVRIITESGKVIEGSEDHPVLTP QGYVYLGNVKEGDEVLIYPFEGVEFEERKGVLLSEDDFKGE DGQIVKFLRERKLLPLRWDDPRIGTLARILGFAFGDGHLGE MDGRLYLSFYGKEETLKELKKDLERLGISANLYVRERDYHI ETVSGEYEGRSVSAELRVTSRSFALLMEKLGMPRGRKAETL YNVPEWIKSAPLWVKRNFLAGLFAADGSIVEFKGNTPLPIN LTQSKAEALEENLRGFMEEIAGLLAEFGIRTTVYRVKSKKG VTYRLALVGEESIRNFLGRINYEYDIEKKAKGLIAYAYLRFK ERVRAERKRAAEIARRVYAETGSVAKAHEAVRDVVNKRFV ERAIYEGEKEPRVPKDFPTFEEFARERGYEGGFVAEKVVKV ERVRPSYEKFYDIGVYHRAHNFIANGVVVHNC (SEQ ID NO: 233) |

3. TABLE 3-continued

| | |
|---|---|
| Tth-DSM571 RIR1 | PCVTGDTWVMTTEGPKQVNDLIGKPFEAVINGRFYRTTNEG<br>FFKTGHKHIVLVETIEGYSIRLTDDHKILKVVDSSLNEMKTE<br>WVSAIELKPGDKIILNNNRNLIGWSGELDEGDGYLLGLLVG<br>DGVLKRDTAILSVWKEGKAVGDVNNCGVDNVMQYALDC<br>AMRLPHRRDFTGWMEIKGRNEYRLKLASLRDLALKMGMH<br>NGFKTVTPELEKMSSSAYIGFIRGLFDCDASVQGSPEKGASI<br>RLAQSDLDLLKAVQRMLLRLGIVSKIYVNRRKASMKLMPD<br>GKGSLKEYKIKPQHELCISGDNIEIYAKRIGFQDLKKMHRLN<br>TLLSSYKKGSHQERFVARVLDIKESGFEDVYDVQVPGINSF<br>DANGIIIHNC (SEQ ID NO: 234) |
| Tth-HB27 RIR1-2 | PCFVGSTRIPTERGLVPIEELAREGGSFYLVTDNRAPFGGRG<br>APLPGHGTAVRKAVRAFFTGVKPVVRLRTREGLEVTLTPDH<br>LLLTPEGYREAGKLRPGEKILVQSGEGLFPKEESLPAQALAV<br>VHERVATAGGRGGRGRADVRAQYRNLPTRWSRELGVALG<br>WLLGDGYLREDGVGFYFSRKDFADLAWLPDLLRDWFGPG<br>TLQETRSNTFHLHFNRIPAEFFQALGVKAARATEKRVPESLF<br>RAPREAVVGFLQGLFSADGSVQINENKQDATVRLASSSLAL<br>LQDVQLLLLNLGILGKIHKRREAARKALPDGKGGLREYPVA<br>PQYELILGGENRDRFAEVVGFLQEEKQSKLLAFLRHRPRGS<br>YRKPFLATVASVEPAGEAPVYDLTEPVTHSLIANGLVAHNC<br>(SEQ ID NO: 235) |
| Tth-HB8 RIR1-2 | PCFVGSTRIPTERGLVPIEELAREGGSFYLVTDNRAPFGGRG<br>APLPGHGTAVRKAVRAFFTGVKPVVRLRTREGLEVTLTPDH<br>LLLTPEGYREAGKLRPGEKILVQSGEGLFPKEESLPAQALAV<br>VHERVATAGGRGGRGRADVRAQYRNLPTRWSRELGVALG<br>WLLGDGYLREDGVGFYFSRKDFADLAWLPDLLRDWFGQG<br>TLQETRSDTFHLHFNRIPAEFFQALGLKAARATEKRVPESLF<br>RAPREAVVGFLQGLFSADGSVQINEKKQDATIRLASSSLALL<br>QDVQLLLLNLGILGKIHKRREAARKALPDGKGALREYPVAP<br>QYELILGGENRDRFAEVVGFLQEEKQSKLLAFLRHRPRGSY<br>RKPFLATVASVEPAGEAPVYDLTEPVTHSLIANGLVAHNC<br>(SEQ ID NO: 236) |
| Tvu DnaE | YCLSGETAVMTVEYGAIPIRRLVQERLICQVYSLDPQGHLY<br>TQPIAQWHFQGFRPVYAYQLEDGSTICATPDHRFMTTSGQM<br>LPIEQIFREGLELWQVAIAPPGALAQGLKPAVQMSCMKIVG<br>RRLVGWQAVYDIGLAGDHNFLLANGAIAANC (SEQ ID NO:<br>237) |
| Unc-ERS PFL | YCFTGNTEISTDRGLFKIKDIVEKHIECRVYDYAGNFSPIKKY<br>YKRETSSLLEIRPFLHSDAISCTLNHEFFVYNSKANEFIKKEA<br>QYINVKEDYLVITIPQKEIFNYKLDVNNAIEDLYQELTFKQR<br>FSNEEVIREVKELRKRGFSWRKIFKRFNLTDHLRRVIERKEA<br>LDSKILPIVKERDGKVAVKGSNFFIDKFIEVTPKFTRLLGYYL<br>SEGCSSKDIGRKNSYYVSFTFNSKEKEYIRDTKEIFSETFKTE<br>LKEVESKKCKTLSLVSYKGIIGLFFKYYFGEDVYNKKLPTEF<br>IYLDKDLQKQLIIGLFRGDGLTSPDFIKKYKKQRIQITSKLLR<br>YQISLILLRLGIKYSIFRKEIIISDKRIFDLLGQSHLITKKVIN<br>TSNRYGFLDDKHLYLKINSVKKLNKKTKVYNLEIDNPTHSYN<br>VNLISVSNC (SEQ ID NO: 238) |
| Unc-ERS RIR1 | PCVTADTWVTTAEGPRQVEELIGKKFTAIVNGEEWESSEEG<br>FFETDVKPVYTLKTAEGFELRLTADHPVMKVERMTRYKVE<br>TQWSNAGDLKPGDKIIINNHRDFGNWSVKGKYTEGEGYLIG<br>LLLGDGTIKKLNPWMKAISKKMEKASADFCEGILRGLFDAD<br>GSVQGNQSKGVSIRLAQSDVEILKAVQRILLRFGIFSKVYMN<br>RRGERKVKMPDGKGGVKEYITKPQHELVISNDNILYFAERV<br>GFSDAEKMEKLEKAIWNYKRKMNRERFVASVEEVVPDGV<br>EKVYDVKIPGINAFNANGFVVHNC (SEQ ID NO: 239) |

In some embodiments, the intein further comprises a linker. A linker attached to the intein is referred to herein as an "intein linker". In some embodiments, the intein comprises an N-terminal linker and/or a C-terminal linker. Any suitable intein linker may be used. In some embodiments, the intein linker comprises 5 or less amino acids. In some embodiments, the intein linker comprises 5, 4, 3, 2, or 1 amino acid.

In some embodiments, the fusion protein further comprises a purification tag. Polyhistidine (His6) is a common purification tag and may be used. However, other suitable purification tags may be employed. In some embodiments, the purification tag further comprises a linker. A linker attached to the purification tag is referred to herein as a "tag linker". In some embodiments, the purification tag comprises an N-terminal linker and/or a C-terminal linker. Any suitable tag linker may be used. In some embodiments, the tag linker comprises 5 or less amino acids. In some embodiments, the tag linker comprises 5, 4, 3, 2, or 1 amino acid. In some embodiments, the N-terminal tag linker comprises SG. In some embodiments, the C-terminal tag linker comprises GS.

In some embodiments, the purification tag is inserted within the intein. An appropriate insertion location should not affect the structure and function of the intein. Thus, flexible loops on the intein are preferred insertion positions for the purification tag. In some embodiments, the purification tag may be inserted within a flexible loop of an endonuclease domain in a large intein. In some embodiments, the purification tag may be inserted within a flexible loop within the sequence between the two fragments of a split intein or within the corresponding regions of a mini intein. In some embodiments, the purification tag is inserted within a flexible loop in a mini intein. In some embodiments, the purification is inserted within the mini intein to replace where the endonuclease domain would have been in the corresponding large intein. In some embodiments, the endonuclease domain of a large intein is replaced with a purification tag, thereby generating a mini intein containing the purification tag.

In some embodiments, the purification tag position on PI-PfuI intein is between residue Gly126 and Val418. This region is flexible and structurally conserved in some other inteins. Accordingly, this position may also be employed in other inteins besides the PI-PfuI intein.

In some embodiments, the intein comprises a PI-PfuI mini intein containing an N-terminal linker (e.g. SG, SEQ ID NO: 8), a C-terminal linker (e.g. GS, SEQ ID NO: 9), and a purification tag (e.g. HHHHHH (SEQ ID NO: 7)). Such a mini intein is set forth in the amino acid sequence of SEQ ID NO: 5.

```
                                        (SEQ ID NO: 5)
CIDGKAKIIFENEGEEHLTTMEEMYERYKHLGEFYDEEYNRWGIDVSNV

PIYVKSFDPESKRVVKGKVNVIWKYELGKDVTKYEIITNKGTKILTSPW

HPFFVLTPDFKIVEKRADELKEGDILIGGMPDGSGHHHHHHGSGLEVVR

HITTTNEPRTFYDLTVENYQNYLAGENGMIFVHN
```

In some embodiments, the intein comprises an amino acid sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity with SEQ ID NO: 5.

The amino acid sequence of an exemplary fusion protein containing an A family DNA polymerase is:

```
                                                  (SEQ ID NO: 1)
MLPLFEPKGRVLLVDGHHLAYRTFHALKGLTTSRGEPVQAVYGFAKSLLKA

LKEDGDAVIVVFDAKAPSFRHEAYGGYKAGRAPTPEDFPRQLALIKELVDLLGLARLEV

PGYEADDVLASLAKKAEKEGYEVRILTADKDLYQLLSDRIHVLHPEGYLITPAWLWEK

YGLRPDQWADYRALTGDESDNLPGVKGIGEKTARKLLEEWGSLEALLKNLDRLKPAIR

EKILAHMDDLKLSWDLAKVRTDLPLEVDFAKRREPDRERLRAFLERLEFGSLLHEFGLL

ESPKALEEAPWPPPEGAFVGFVLSRKEPMWADLLALAAARGGRVHRAPEPYKALRDLK

EARGLLAKDLSVLALREGLGLPPGDDPMLLAYLLDPSNTTPEGVARRYGGEWTEEAGE

RAALSERLFANLWGRLEGEERLLWLYREVERPLSAVLAHMEATGVRLDVAYLRALSLE

VAEEIARLEAEVFRLAGHPFNLNSRDQLERVLFDELGLPAIGGCIDGKAKIIFENEGEEHL

TTMEEMYERYKHLGEFYDEEYNRWGIDVSNVPIYVKSFDPESKRVVKGKVNVIWKYEL

GKDVTKYEIITNKGTKILTSPWHPFFVLTPDFKIVEKRADELKEGDILIGGMPDGSGHHH

HHHGSGLEVVRHITTTNEPRTFYDLTVENYQNYLAGENGMIFVHNTGKTGKRSTSAAV

LEALREAHPIVEKILQYRELTKLKSTYIDPLPDLIHPRTGRLHTRFNQTATATGRLSSSDPN

LQNIPVRTPLGQRIRRAFIAEEGWLLVALDYSQIELRVLAHLSGDENLIRVFQEGRDIHTE

TASWMFGVPREAVDPLMRRAAKTINFGVLYGMSAHRLSQELAIPYEEAQAFIERYFQSF

PKVRAWIEKTLEEGRRRGYVETLFGRRRYVPDLEARVKSVREAAERMAFNMPVQGTA

ADLMKLAMVKLFPRLEEMGARMLLQVHDELVLEAPKERAEAVARLAKEVMEGVYPL

AVPLEVEVGIGEDWLSAKE
```

This exemplary fusion protein is referred to as an "auto hot start Taq" or "InTaq". These terms are used interchangeably herein and refer to the same fusion protein. This auto hot start Taq used in the following experiments (SEQ ID NO:1) is created by inserting the modified PI-PfuI mini intein (SEQ ID NO:5) into a modified Taq polymerase (SEQ ID NO:3) between residues Gly502 and Thr503. The modified Taq polymerase (SEQ ID NO:3) is modified from wildtype Taq polymerase (SEQ ID NO:2) by mutations Lys505Gly and Glu507Gly to accommodate the inserted intein. The first three N-terminal residues of wildtype Taq polymerase (SEQ ID NO:2), Met1, Arg2 and Gly3 were removed during cloning.

The inserted modified PI-PfuI mini intein (SEQ ID NO:5) is created by inserting N-terminal linker (SEQ ID NO:8), His6 tag (SEQ ID NO:7), and C-terminal linker (SEQ ID NO:9) into a PI-PfuI mini intein (SEQ ID NO:6) between residues Gly131 and Gly132 of the mini intein. The PI-PfuI mini intein (SEQ ID NO:6) is derived from the wildtype PI-PfuI intein (SEQ ID NO:4).

In some embodiments, the fusion protein comprises an amino acid sequence having at least 80% sequence identity with SEQ ID NO: 1. In some embodiments, the fusion protein comprises an amino acid sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity with SEQ ID NO: 1.

The amino acid sequence of an exemplary fusion protein containing a B family DNA polymerase is:

```
                                                  (SEQ ID NO: 10)
MILDVDYITEEGKPVIRLFKKENGKFKIEHDRTFRPYIYALLRDDSKIEEVKKIT

GERHGKIVRIVDVEKVEKKFLGKPITVWKLYLEHPQDVPTIREKVREHPAVVDIFEYDIP

FAKRYLIDKGLIPMEGEEELKILAFDIETLYHEGEEFGKGPIIMISYADENEAKVITWKNID

LPYVEVVSSEREMIKRFLRIIREKDPDIIVTYNGDSFDFPYLAKRAEKLGIKLTIGRDGSEP

KMQRIGDMTAVEVKGRIHFDLYHVITRTINLPTYTLEAVYEAIFGKPKEKVYADEIAKA

WESGENLERVAKYSMEDAKATYELGKEFLPMEIQLSRLVGQPLWDVSRSSTGNLVEWF

LLRKAYERNEVAPNKPSEEEYQRRLRESYTGGFVKEPEKGLWENIVYLDFRALYPSIIITH

NVSPDTLNLEGCKNYDIAPQVGHKFCKDIPGFIPSLLGHLLEERQKIKTKMKETQDPIEKI

LLDYRQKAIKLLANSFYGYYGYAKARWYCKECAESVTAWGRKYIELVWKELEEKFGF

KVLYIDTDGLYATIPGGESEEIKKKALEFVKYINSKLPGLLELEYEGFYKRGFFVTKKRY

AVIDEEGKVITRGLEIVRRDWSEIAKETQARVLETILKHGDVEEAVRIVKEVIQKLANYEI

PPEKLAIYEQITRPLHEYKAIGPHVAVAKKLAAKGVKIKPGMVIGYIVLRGGGCIDGKAK

IIFENEGEEHLTTMEEMYERYKHLGEFYDEEYNRWGIDVSNVPIYVKSFDPESKRVVKG

KVNVIWKYELGKDVTKYEIITNKGTKILTSPWHPFFVLTPDFKIVEKRADELKEGDILIGG

MPDGSGHHHHHHGSGLEVVRHITTTNEPRTFYDLTVENYQNYLAGENGMIFVHNTGKI

SNRAILAEEYDPKKHKYDAEYYIENQVLPAVLRILEGFGYRKEDLRYQKTRQVGLTSWL

NIKKS
```

This exemplary fusion protein is referred to herein as "auto hot start Pfu" or "InPfu". These terms are used interchangeably herein and refer to the same fusion protein. The exemplary auto hot start Pfu used in the following experiments (SEQ ID NO:10) is created by inserting the modified PI-PfuI mini intein (SEQ ID NO:5) into a modified Pfu polymerase (SEQ ID NO:12) between residues Gly709 and Thr710. The modified Pfu polymerase (SEQ ID NO:12) is modified from wildtype Pfu polymerase (SEQ ID NO:11) by mutations Asp708Thr and Pro710Lys, and inserting two glycines between Arg706 and Gly707 to accommodate the inserted intein.

In some embodiments, the fusion protein comprises an amino acid sequence having at least 80% sequence identity with SEQ ID NO: 10. In some embodiments, the fusion protein comprises an amino acid sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity with SEQ ID NO: 10.

The fusion proteins described herein may be incorporated into compositions. Such compositions find use in a variety of methods. Suitable methods include, for example, PCR, RT-PCR, reverse transcription, isothermal amplification, genotyping, cloning, mutation detection, sequencing, microarrays, forensics, paternity testing, diagnostic PCR, and gene synthesis. In some embodiments, the composition further comprises a nucleic acid template (e.g. a nucleic acid intended to be amplified). In some embodiments, the composition further comprises a reaction buffer. Suitable reaction buffers may comprise reagents necessary to perform the desired method. For example, reaction buffers may contain dNTPs, primers, probes, degradation inhibitors, surfactants, PCR additives (e.g. ammonium sulfate, DMSO, formamide, glycerol, and Triton X-100), buffers (e.g. sequencing buffer, PCR buffer, RT-PCR buffer), and the like.

In some embodiments, the fusion proteins described herein may be incorporated into kits. For example, a kit may comprise a fusion protein and one or more additional components. The components of the kit may be packaged separately or together. The kit may additionally comprise instructions for using the kit. Instructions included in kits can be affixed to packaging material, can be included as a package insert, or can be viewed or downloaded from a particular website that is recited as part of the kit packaging or inserted materials. While the instructions are typically written or printed materials they are not limited to such. Any medium capable of storing such instructions and communicating them to an end user is contemplated by this disclosure. Such media include, but are not limited to, electronic storage media (e.g., magnetic discs, tapes, cartridges, chips), optical media (e.g., CD ROM), and the like. As used herein, the term "instructions" can include the address of an internet site that provides the instructions. In some embodiments, the kit comprises a fusion protein as described herein and a suitable reaction buffer, depending on the intended use of the kit. For example, kits intended for use in RT-PCR (e.g. one-step RT-PCR, two-step RT-PCR) may additionally comprise a suitable PCR reaction buffer. Kits intended for use in two-step RT-PCR may additionally comprise a reverse transcriptase. In some embodiments, provided herein is a kit for one-step RT-PCR comprising a fusion protein comprising a DNA polymerase possessing reverse transcriptase activity. Such a kit may be particularly useful for rapid and specific diagnostic tests, such as for SARS-CoV-2 or influenza.

In some aspects, provided herein are methods of using the fusion proteins described herein. In some embodiments, provided herein is a method of amplifying nucleic acid. The method comprises providing a composition comprising a nucleic acid template and a fusion protein comprising as described herein. In some embodiments, the method comprises providing a composition comprising a nucleic acid template and a fusion protein comprising a target DNA polymerase and an intein inserted at a designated position in the target DNA polymerase. Insertion of the intein at the designated position inhibits activity of the target DNA polymerase. The method further comprises modifying one or more factors to induce release of the target DNA polymerase from the fusion protein. The released target DNA polymerase possesses increased activity compared to the target DNA polymerase containing the inserted intein. The method further comprises amplifying the nucleic acid template in the composition.

In some embodiments, protein splicing activity of the intein is regulated by the one or more external factors. As described above, these external factors may include physical factors such as light and temperature, and chemical factors such as pH, salt, ligand binding, etc. Activation of protein splicing as a result of modifying the one or more factors results in release of the target DNA polymerase from the fusion protein. The released target DNA polymerase possesses increased activity (e.g. increased DNA polymerase activity and/or increased exonuclease activity) compared to the activity of the target DNA polymerase when present in the fusion protein. Accordingly, the methods described herein allow for the target DNA polymerase to only perform its enzymatic function when desired characteristics are achieved. For example, the methods described herein allow for the target DNA polymerase to only perform its enzymatic function when a set temperature and/or pH is achieved, thereby activating the intein and inducing the splicing reaction, thereby freeing the DNA polymerase from the inhibition of the intein. As another example, the methods described herein allow for the target DNA polymerase to perform its enzymatic function when a suitable agent (e.g. chelating agent) is added to the composition disinhibit the intein from a divalent metal ion, thereby activating the splicing reaction and inducing release of the DNA polymerase from the fusion protein. Such methods are therefore useful in allowing for amplification of a nucleic acid template only when desired, thus reducing non-specific amplification.

In some embodiments, the fusion proteins or compositions comprising the same find use in methods involving reverse transcription. Reverse transcription (RT) is the process of synthesizing DNA from an RNA template. It can be followed by a PCR reaction to amplify the synthesized DNA. Reverse transcription-polymerase chain reaction (RT-PCR) is the coupling of reverse transcription reaction and PCR. This technology is widely used for synthesizing the cDNA from mRNA, or detecting specific target sequence from any RNA source such as viral genome RNA. The reaction starts with the reverse transcription catalyzed by a polymerase containing reverse transcriptase activity, which synthesizes the DNA fragment complementary to the RNA template. Then in the regular PCR step, a PCR compatible polymerase amplifies the target DNA fragment using the DNA template synthesized from the reverse transcription step.

In general, RT-PCR is performed using one reverse transcriptase (RT family DNA polymerases) for RT and one thermally stable DNA polymerase for PCR. Currently, the widely used reverse transcriptases from viruses can synthesize long DNA products at a high rate. However, these enzymes are not thermally stable and could inhibit PCR reaction. Additionally, these reverse transcriptases require a low temperature for RT, which leads to nonspecific DNA synthesis catalyzed by the DNA polymerase. Accordingly, the fusion proteins described herein would be advantageous over those currently used in the art due to their thermal stability and conditional activation (e.g. temperature sensitivity of the intein). In some embodiments, the fusion protein and compositions described herein may be used for one-enzyme RT-PCR (e.g. one-step RT-PCR). For example, fusion proteins comprising a DNA polymerase with both reverse transcriptase and DNA polymerase activity may be employed for one-enzyme RT-PCR methods (e.g. without the need for an additional reverse transcriptase). In other embodiments, the fusion proteins and compositions described herein may be used for two-enzyme RT-PCR (e.g. two-step RT-PCR), by using a separate enzyme with reverse transcriptase activity and subsequently using a fusion protein comprising a DNA polymerase as described herein.

An RNA extraction step is usually conducted before RT-PCR for virus detection. It denatures viral capsid to release viral RNA for detection and denatures RNases to protect RNA samples. It can be conducted using an RNA extraction kit or heat treatment to break the virus. This step could take 30 minutes or longer and part of the RNA sample could be lost during this process. The reason that heat-treated RNA extraction is typically a separate step is that common reverse transcriptases are not thermally stable. Therefore, they cannot withstand the heat during RNA extraction. Hence, a separated step is required, which adds complexity to the virus detection process and increases the odds of error. The denatured RNases could also refold between these steps and new RNases contamination could be introduced into the reaction. In contrast, in some embodiments, the fusion proteins provided herein may be used in heat-treatment RT-PCR. For example, for thermally stable DNA polymerases described herein that have reverse transcriptase activity, the heat-treatment RNA extraction step can be conducted directly in the RT-PCR reaction (referred to as heat-treatment RT-PCR, or HT-RT-PCR), since the polymerases can retain activity even after being boiled. Fusion proteins provided herein that find use in HT-RT-PCR possess numerous advantages. For example, since there is no transfer between the steps, all viral RNA is used directly for RT-PCR and the loss of the RNA sample could be minimized. In addition, handling time can be greatly shortened by cutting additional steps, and the risk of contamination is greatly reduced.

In some embodiments, the fusion protein may be mixed with other unmodified or modified DNA polymerases, such as an unmodified or modified Taq polymerase or Pfu polymerase, for its use.

In some embodiments, the fusion proteins described herein may be used in methods involving PCR. Polymerase Chain Reaction (PCR) is one of the most common reactions used in life sciences, medical, and clinical laboratories. It is used for synthesizing specific DNA sequences based on a template sequence through thermal cycles. A standard PCR thermal cycle contains three steps: denaturation, annealing, and synthesis. The denaturation step uses high temperature to generate the single strand template. Then, the annealing step lowers the temperature so that the designed oligonucleotide binds to the target position on the template. This designed oligonucleotide acts as the primer for DNA synthesis by providing the 3'-OH group and assigning the synthesis initiation position. During the synthesis step, the proper temperature is maintained for the DNA polymerase to catalyze DNA synthesis. New copies of DNA are generated in each thermal cycle, which are used as templates in the later cycles. Thus, repeating the three steps establishes a chain reaction to amplify the original DNA template. In quantitative PCR (qPCR, or real-time PCR), fluorescence is introduced during synthesis, so that the DNA products can be quantitatively measured in real-time. Many other PCR based technologies have also been developed for specific applications, such as digital PCR, solid-phase PCR, etc.

Standard PCR and modified versions have various applications, such as amplifying specific sequences, fusing sequences, generating mutations into DNA products, generating DNA sequence libraries, amplifying the whole genome, DNA de novo synthesis, introducing unnatural or modified nucleotides into DNA products, etc. Because the target sequence is amplified exponentially, PCR and PCR based technologies have been used to detect specific sequences, such as viral sequences, or single-nucleotide polymorphism (SNP) for clinical diagnoses. These applications have been routinely used in life sciences, medical, and clinical laboratories. The fusion proteins described herein may be used in any of these or other methods involving PCR.

In some embodiments, the fusion proteins and compositions described herein may be used in methods involving isothermal amplification. DNA polymerase based isothermal amplification is another technology for DNA synthesis. Isothermal amplification reactions are conducted at a constant temperature, which use the strand displacement activity of DNA polymerases, specifically designed primers, and additional enzymes to generate single-strand regions on the template for primer binding and DNA synthesis. Several isothermal amplification technologies have been commercialized: helicase-dependent amplification (HDA), recombinase polymerase amplification (RPA), rolling circle amplification (RCA), loop-mediated isothermal amplification (LAMP), strand displacement amplification (SDA), multiple displacement amplification (MDA, also used for whole genome amplification, WGA), ramification amplification (RAM), etc. DNA polymerase based isothermal amplification technologies have been widely used for nucleic acids amplification and detection. The fusion proteins described herein may be used in any of these methods.

In some embodiments, the fusion proteins and compositions described herein may be used in methods involving sequencing. DNA or RNA sequencing is the technique to determine the sequence of nucleotides in DNA or RNA. DNA polymerase duplicates a template strand by probing the base information of the template strand and accordingly incorporating the correct nucleotides into the newly synthesized strand. Thus, DNA polymerase mediated synthesis can be used to sequentially extract nucleotide information of a template. So far, three generations of sequencing technologies have been developed. The first generation sequencing is Sanger sequencing, which is a PCR based sequencing technology. DNA polymerase randomly incorporates different fluorescence-labeled dideoxynucleotides that terminate DNA synthesis, producing fluorescence-labeled DNA products with all possible lengths. The fluorescence provides the base information of the nucleotide, and the length of the DNA product provides the position information of the nucleotide. The combination of both information results in the sequence of the template. The second generation sequencing, or next-generation sequencing (NGS, short-read NGS), is a high throughput sequencing technology. The sample is first broken down to small fragments, followed by PCR based clonal amplification of each fragment. Each fragment is then sequenced by different strategies and combined into the sequence of the template. The third generation sequencing (long-read NGS, single molecule sequencing) extends the read for each sequencing process and directly reads the sequence of the sample, while some third generation sequencing technologies use PCR to amplify the sample. Each of these sequencing technologies require DNA polymerases to amplify the sample by PCR (first, second, and some third generation), incorporate labeled nucleotides (first, some second, and some third generation), and generate reads by DNA synthesis (first, some second, and some third generation). The fusion proteins and compositions described herein may be used in any of these sequencing methods.

The following examples further illustrate the invention but, of course, should not be construed as in any way limiting its scope.

Example 1

Materials and Methods

Protein Design

The modeled PI-PfuI mini intein was based on the structure of wild-type PI-PfuI intein (PDB ID: 1DQ3). The modeled InTaq was based on the modeled PI-PfuI mini intein and the structure of Taq DNA polymerase (PDB ID: 1TAQ). The modeled InPfu was based on the modeled PI-PfuI mini intein and the structure of Pfu DNA polymerase (PDB ID: 4AIL). Modeling was conducted using coot and Phenix. Figures generated using UCSF ChimeraX.

Cloning

The DNA fragment of wildtype Taq DNA polymerase was amplified using primers forward 5'GGAATTC-CATATGCGTGGTATGCTGCCGCTGTTT-GAACCGAAAGGTCGTGTCCTC-3' (SEQ ID NO: 240) and reverse 5'-ACGCGTCGACTTATTACTCCTTGGCG-GAGAGCCAGT-3' (SEQ ID NO: 241) and digested by NdeI and SalI. The fragment was inserted into pET21a vector between NdeI and XhoI sites, resulting in the construct named pET-Taq. The following DNA fragment was synthesized:

(SEQ NO: 242)

```
GGCCGGCCACCCCTTCAACCTCAACTCCCGGGACCAGCTGGAAAGGGTCCTCTTTGA

CGAGCTAGGGCTTCCCGCCATCGGCGGTTGCATAGACGGAAAGGCCAAGATAATCT

TTGAGAACGAAGGTGAGGAGCATCTAACGACGATGGAGGAGATGTACGAGAGATA

CAAGCATCTAGGTGAAIDTTCTACGATGAGGAATACAATAGATGGGGAATTGATGTTTC

AAACGTTCCTATTTATGTAAAGTCATTCGATCCAGAGAGTAAGAGAGTCGTCAAAGG
```

-continued

```
TAAGGTGAATGTGATATGGAAGTACGAGCTTGGGAAGGATGTTACTAAGTACGAAA

TCATTACCAACAAGGGGACTAAGATACTAACATCTCCCTGGCATCCGTTCTTCGTTC

TGACACCTGACTTTAAGATAGTGGAGAAGAGGGCTGATGAGCTCAAGGAAGGAGAC

ATTTTAATCGGCGGAATGCCAGATGGCTCTGGTCATCACCATCACCATCACGGTTCT

GGTCTCGAAGTTGTGAGGCATATAACAACCACGAACGAGCCGAGGACGTTCTACGA

TCTAACCGTTGAAAACTACCAGAACTATTTGGCGGGAGAAAATGGAATGATTTTCGT

CCACAACACCGGTAAAACCGGCAAGCGCTCCACCAGCGCCGCCGTCCTGGAGGCCC

TCCGCGAGGCCCACCCCATCGTGGAGAAGATCCTGCAGTACCGGGAGCTCACCAAG

CTGAAGAGCACCTACATTGACCCCTTGCCGGACCTCATCCACCCCAGGACGGGCCGC

CTCCACACCCGCTTCAACCAGACGGCCACGGCCACGGGCAGGCTAAGTAGCTCCGA

TCCCAACCTCCAGAACATCCCCGTCCGCACCCCGCTTGGGCAGAGGATCC.
```

The synthesized fragment was digested by FseI and BamHI, and then inserted into pET-Taq between FseI and BamHI sites, resulting in the construct named pET-InTaq. The protein product expressed from pET-InTaq is auto hot start Taq DNA polymerase (InTaq).

The DNA fragment of wildtype Pfu DNA polymerase was amplified using primers forward 5'-GGAATTCCATATGATTTTAGATGTGGATTACATAACTGAAGAA-3' (SEQ ID NO: 243) and reverse 5'-CCGCTCGAGTTATTAGGATTTTTTAATGTTAAGCCAGGAAGTTAG-3' (SEQ ID NO: 244), and digested by NdeI and XhoI. The fragment was inserted into pET21a vector between NdeI and XhoI sites, resulting in the construct named pET-Pfu. The following DNA fragment was synthesized:

```
                                              (SEQ ID NO: 245)
AAGCTTGCCAATTATGAAATTCCACCAGAGAAGCTCGCAATATATGAGCAGATAAC

AAGACCATTACATGAGTATAAGGCGATAGGTCCTCACGTAGCTGTTGCAAAGAAAC

TAGCTGCTAAAGGAGTTAAAATAAAGCCAGGAATGGTAATTGGATACATAGTACTT

CGTGGTGGCGGTTGCATAGACGGAAAGGCCAAGATAATCTTTGAGAACGAAGGTGA

GGAGCATCTAACGACGATGGAGGAGATGTACGAGAGATACAAGCATCTAGGTGAAT

TCTACGATGAGGAATACAATAGATGGGGAATTGATGTTTCAAACGTTCCTATTTATG

TAAAGTCATTCGATCCAGAGAGTAAGAGAGTCGTCAAAGGTAAGGTGAATGTGATA

TGGAAGTACGAGCTTGGGAAGGATGTTACTAAGTACGAAATCATTACCAACAAGGG

GACTAAGATACTAACATCTCCCTGGCATCCGTTCTTCGTTCTGACACCTGACTTTAAG

ATAGTGGAGAAGAGGGCTGATGAGCTCAAGGAAGGAGACATTTTAATCGGCGGAAT

GCCAGATGGCTCTGGTCATCACCATCACCATCACGGTTCTGGTCTCGAAGTTGTGAG

GCATATAACAACCACGAACGAGCCGAGGACGTTCTACGATCTAACCGTTGAAAACT

ACCAGAACTATTTGGCGGGAGAAAATGGAATGATTTTCGTCCACAACACCGGTAAA

ATTAGCAATAGGGCAATTCTAGCTGAGGAATACGATCCCAAAAAGCACAAGTATGA

CGCAGAATATTACATTGAGAACCAGGTTCTTCCAGCGGTACTTAGGATATTGGAGGG

ATTTGGATACAGAAAGGAAGACCTCAGATACCAAAAGACAAGACAAGTCGGCCTAA

CTTCCTGGCTTAACATTAAAAAATCCTAATAACTCGAG
```

The synthesized fragment was digested by HindIII and XhoI, and then inserted into pET-Pfu between HindIII and XhoI sites, resulting in the construct named pET-InPfu. The protein product expressed from pET-InPfu is auto hot start Pfu DNA polymerase (InPfu).

Protein Expression and Purification

The plasmids carrying the target genes were transferred into BL21 star (DE3) Rosetta 2. The strains were cultured in the presence of antibiotics for selection, and the glycerol stocks were prepared and used for the subsequent protein expression. The protein expression was started by incubating the glycerol stocks in 1 L Lysogeny broth media with antibiotics. The cell was cultured at 37° C. and induced with 0.5 mM Isopropyl 0-D-1-thiogalactopyranoside (IPTG) for protein expression. The cells were further cultured for 6 hours and collected for protein purification.

The collected cells were resuspended in lysis buffer (20 mM Tris-HCl pH 8.0, 500 mM NaCl) and lysed by passing microfluidizer 5 times. The lysate was then incubated at 60°

C. for 25 min, followed by 5 min incubation on ice. The lysate was clarified by high speed centrifugation for 30 min at 4° C. The clarified supernatant was collected and loaded onto 5 ml HisTrap column pre-equilibrated with NiA buffer (20 mM Tris-HCl pH 8.0, 500 mM NaCl, 10 mM imidazole). The column was then extensively washed by NiA buffer, and the fusion proteins were eluted by NiB buffer (20 mM Tris-HCl pH 8.0, 500 mM NaCl, 300 mM imidazole). The eluted protein was diluted by 10 folds using dilution buffer (5 mM Tris-HCl pH 8.0) and then loaded onto 5 ml HiTrap Q column. The column was washed by QA buffer (20 mM Tris-HCl pH 8.0, 50 mM NaCl) and the target protein was eluted by NaCl gradient. The final purified target protein was exchanged to buffer (20 mM Tris-HCl pH 8.0, 50 mM KCl) and stored at −80° C. The protein concentration was determined by UV280 absorption and protein extinction coefficient (InTaq: 144160, InPfu: 160440).

Protein Splicing Assay

The protein splicing activities of the fusion proteins were determined by the protein splicing assay. The purified protein was diluted to 0.5 mg/ml in different buffers and incubated with varying temperature and time. The reaction products are then examined by 8% SDS-PAGE gel. All gels were analyzed by Bio-Rad Quantity One to measure band intensity. Charts and fittings were generated by GraphPad Prism 6.

DNA Elongation Assay

The DNA polymerase activities of the proteins were determined by the DNA elongation assay. The DNA substrate used in the assay contains the sequence 5'-CGAAC-GATGTGAACCTAATAACGTCTCTCGCGGCC-GATCTGCCGGCCGCGAGAGAC GT-3' (SEQ ID NO: 246). The substrate was dissolved in water at 100 μM and incubated at 95° C. for 5 min, followed by annealing on ice for 30 min. The different polymerases at 0.01 mg/ml were mixed with 0.5 μM DNA substrates and 0.25 mM each dNTP in 20 μl volume with standard Taq DNA polymerase reaction buffer (10 mM Tris-HCl pH 8.3, 50 mM KCl, 1.5 mM $MgCl_2$) or standard Pfu DNA polymerase reaction buffer (120 mM Tris-HCl pH 8.8, 10 mM KCl, 6 mM ammonium sulfate, 1.5 mM MgCl2, 0.1% Triton X-100, 0.001% BSA). The pre-activation of the auto hot start DNA polymerases was conducted by incubation at 80° C. for 5 min followed by incubation on ice-water bath. The reactions were conducted at various temperatures and incubation time as indicated. After incubation, 20 μl 2×denature loading buffer (95% deionized formamide, 0.025% (w/v) bromophenol blue, 0.025% (w/v) xylene cyanol FF, 5 mM EDTA) was mixed with each reaction. The sample was incubated at 95° C. for 5 min and then loaded onto 10% 8 M Urea-PAGE gel. After electrophoresis, the gel was stained by ethidium bromide and imaged under ultraviolet light.

Exonuclease Assay

The 3'-5' exonuclease activities of the proteins were determined by the exonuclease assay. The DNA substrate used in the assay contains the sequence 5'-TGTTCTCCTCTTCCGCTGCTCCCGC-GATCTGCCGCGGGAGCAGCGGAAGAGGAGAAC A-3' (SEQ ID NO: 247). The substrate was dissolved in water at 100 μM and incubated at 95° C. for 5 min, followed by annealing on ice for 30 min. The different polymerases at 0.01 mg/ml were mixed with 0.5 μM DNA substrates in 20 μl volume with standard Pfu DNA polymerase reaction buffer (120 mM Tris-HCl pH 8.8, 10 mM KCl, 6 mM ammonium sulfate, 1.5 mM MgCl2, 0.1% Triton X-100, 0.001% BSA). The pre-activation of the auto hot start DNA polymerases was conducted by incubation at 80° C. for 1 h followed by incubation on ice-water bath. The reactions were conducted at 50° C. for 1 h incubation. After incubation, 20 μl 2×denature loading buffer (95% deionized formamide, 0.025% (w/v) bromophenol blue, 0.025% (w/v) xylene cyanol FF, 5 mM EDTA) was mixed with each reaction. The sample was incubated at 95° C. for 5 min and then loaded onto 10% 8 M Urea-PAGE gel. After electrophoresis, the gel was stained by ethidium bromide and imaged under ultraviolet light.

PCR

The PCR capabilities of the fusion proteins were determined by PCR. InTaq or InPfu was mixed with 100 ng DNA templates, 10 pmol each primer, and 0.25 mM each dNTP in 50 μl volume with standard Taq DNA polymerase reaction buffer or standard Pfu DNA polymerase reaction buffer. The mixture was loaded onto PCR machine with the following program: first incubation at 80° C. for 5 min; followed by 30 thermal cycles of 94° C. for 30 sec, 55° C. for 30 sec, and 72° C. for 10 sec to 6 min depending on the target DNA length (1 kb/minute); then the temperature is kept at 72° C. for 5 min. After PCR, 5 μl sample was mixed with loading dye and loaded onto 1% agarose-TBE gel containing ethidium bromide. After electrophoresis, the gel was imaged under ultraviolet light.

Results

Design of Auto Hot Start DNA Polymerases

Many A, B, and RT family DNA polymerases have been used for DNA amplification applications such as PCR and isothermal amplification, and Taq DNA polymerase is one of the most commonly used DNA polymerases. This A family DNA polymerase from *Thermus aquaticus* contains 5' to 3' polymerase activity and 5' to 3' exonuclease activity. Taq DNA polymerase has adequate stability and activity at high temperature to enable PCR. Accordingly, this widely-used DNA polymerase was selected to validate the design for A family DNA polymerase.

The structures of Taq DNA polymerase were critically investigated to look for an insertion location for the temperature-sensitive intein. The insertion position should inhibit DNA polymerase activity in the presence of the intein, support the intein protein splicing reaction, and result in a functional Taq DNA polymerase after the intein is spliced. The intein inhibition of the DNA polymerase activity could be achieved by physically blocking the Taq DNA polymerase active site, compromising its DNA binding ability, or disrupting its function allosterically. Multiple regions on different Taq DNA polymerase domains satisfy these criteria. Since it was desirable to create a design that is transferable to other A family DNA polymerases, structurally conserved regions of the Taq DNA polymerase catalytic core: thumb, finger, and palm domains were the focus of a suitable intein insertion location.

To support the intein protein splicing reaction, the insertion location should not compromise the intein structure and function. Moreover, to result in a functional Taq DNA polymerase after the intein is spliced, the insertion location should not hinder the release of the intein. Taq DNA polymerase does not naturally contain the extein consensus sequence that supports intein splicing, which needs to be created by mutation or insertion. Thus, the insertion location should minimalize the required modifications to have limited or no effect on the activity or function of Taq DNA polymerase. According to these criteria, the insertion location of the intein should be on flexible loops of Taq DNA polymerase, since loops are structurally flexible to allow the intein to conduct protein splicing and likely to minimize its interferences with other parts of Taq DNA polymerase.

Thus, the insertion location was selected on a loop in the thumb domain of Taq DNA polymerase between residue Leu494 and Ala517 (H1H2 loop). The conformational changes of the thumb domain and the H1H2 loop are critical for the binding of the DNA substrate. Thus inserting a protein domain in this loop should not only physically block the entrance of the DNA substrate but also hinder the conformational changes required for building the interactions between the thumb domain and the DNA substrate (FIG. 1C). Additionally, H1H2 loop is flexible and structurally conserved among A family polymerases, which makes it easy to apply this design to other A family enzymes. Moreover, this region is far away from the Taq DNA polymerase active site and other residues required for the polymerase activity. Thus, the mutations should have minimal effect on the Taq DNA polymerase activity.

To develop auto hot start Taq DNA polymerase, the intein needs to be capable of temperature-induced splicing (FIG. 1A). It is also preferred that the intein is from a thermophilic organism to have sufficient thermal stability, efficient protein splicing activity, and only catalyze protein splicing reaction after reaching a certain temperature, for example, 50° C. Moreover, the size of the intein should be neither too small to compromise inhibition, nor too big to interfere with the folding of Taq DNA polymerase. Based on these criteria, the mini intein of the PI-PfuI intein was chosen (FIG. 1B). The PI-PfuI mini intein is obtained by removing the endonuclease domain between residues Gly126 and Val418 of the wildtype PI-PfuI intein from *Pyrococcus furiosus*. Because the extein consensus sequences for PI-PfuI intein are GGG (−3 to −1) and TGL (+1 to +3), the intein was inserted between Lys505 and Thr506 in H1H2 loop with two mutations Lys505Gly and Glu507Gly to facilitate the splicing activity. Based on the structure, Lys505 and Glu507 are not involved in the binding of the DNA substrate.

To facilitate the purification of the auto hot start Taq DNA polymerase, a polyhistidine (His6) tag was inserted in the PI-PfuI mini intein so that only the intein-containing proteins are selected during affinity chromatography. This insertion should not affect the structure and function of the intein. Thus, the His6 tag was inserted between PI-PfuI intein residues Gly126 and Val418 to replace the deleted endonuclease domain (FIG. 1B). This region is flexible and structurally conserved in several other inteins, which could be applied to other inteins if needed.

The candidate auto hot start Taq DNA polymerase was modeled by fusing the structures of Taq DNA polymerase, PI-PfuI mini intein, and the His6 tag (FIG. 1C). According to the modeled structure, PI-PfuI mini intein physically blocks the space between thumb and finger domains, and should be able to suppress DNA binding to the Taq DNA polymerase active site. Moreover, in certain conformations, PI-PfuI mini intein could clash with the finger domain. Thus, the presence of the intein should interfere with the conformational changes of the Taq DNA polymerase thumb domain, which are essential for catalyzing DNA amplification. Therefore, the auto hot start Taq DNA polymerase (InTaq) should have no DNA polymerase activity before protein splicing.

Besides Taq DNA polymerase and other A family DNA polymerases, many B family DNA polymerases are also widely used in PCR and other DNA amplification applications. These B family DNA polymerases usually contain a functional 3'-5' exonuclease domain for proofreading to remove misincorporated nucleotides. Thus, they have a lower error rate and are often used as high-fidelity DNA polymerases. Pfu DNA polymerase from *Pyrococcus furiosus*, one of the most commonly used commercial B family DNA polymerases, was selected to validate the design for B family DNA polymerase. It has both 5' to 3' polymerase activity and 3' to 5' exonuclease activity. Pfu DNA polymerase has better thermal stability than Taq DNA polymerase but its activity is slower.

The structures of Pfu DNA polymerase were carefully inspected to look for an insertion location of PI-PfuI mini intein based on the criteria described above. The insertion location was chosen between residues Gly707 and Asp708 on the Leu705-Arg714 loop of Pfu DNA polymerase thumb domain. The candidate auto hot start Pfu DNA polymerase was modeled by fusing the structures of Pfu DNA polymerase, PI-PfuI mini intein, and the His6 tag (FIG. 1D). According to the modeled structure, PI-PfuI mini intein should be able to suppress DNA binding to the Pfu DNA polymerase active site and hinder the conformational changes of the thumb domain, restricting Pfu DNA polymerase catalysis. Pfu DNA polymerase was modified by Asp708Thr and Pro710Lys mutations, and inserting two glycines between Arg706 and Gly707 to accommodate the inserted intein. Since this region is far away from the Pfu DNA polymerase active site and not involved in the binding of DNA substrate, these mutations should have minimal effect on Pfu DNA polymerase activity. Moreover, this flexible region is structurally conserved in other B family DNA polymerases. Hence, this design of auto hot start Pfu DNA polymerase (InPfu) could be transferred to other B family enzymes.

Fusion Protein Expression and Purification

Figure 2:
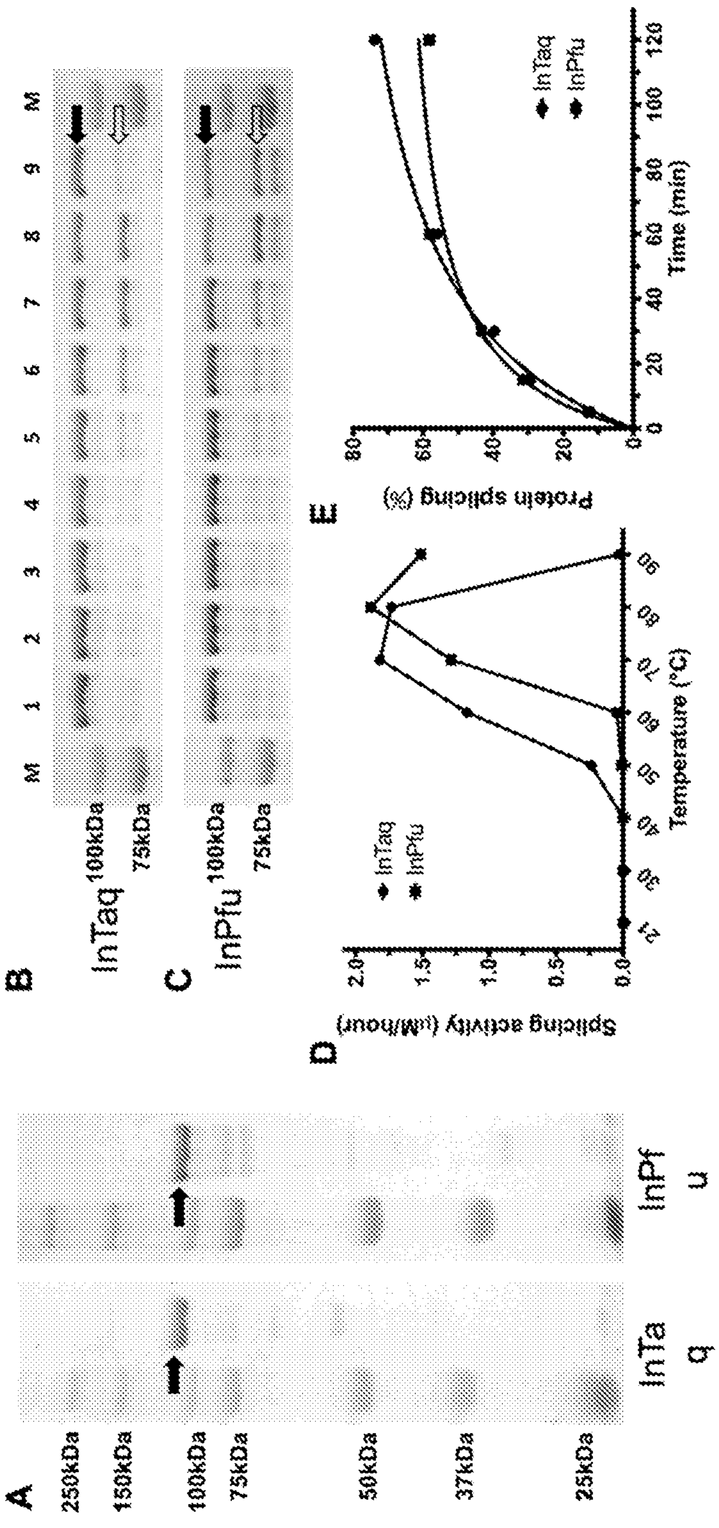
FIG. 2: protein expression and purification results of InTaq and InPfu (A), and temperature-induced protein splicing (B-E). Proteins are shown on 8% Coomassie blue stained SDS-PAGE and the positions of auto hot start polymerases are indicated by black arrows. A. The final purified InTaq and InPfu are over 90% purity. B-C. Protein splicing assay of InTaq (B) and InPfu (C) at various temperatures. The positions of the activated Taq DNA polymerase (B) and Pfu DNA polymerase (C) after protein splicing are indicated by the empty arrows. Lane M, ladder; 1, untreated; 2, 21° C., 24 h; 3, 30° C., 1 h; 4, 40° C., 1 h; 5, 50° C., 1 h; 6, 60° C., 1 h; 7, 70° C., 1 h; 8, 80° C., 1 h; 9, 90° C., 1 h. D. protein splicing activities of InTaq and InPfu at various temperatures. The optimal temperature for the reaction is around 70-80° C. E. protein splicing assay of InTaq and InPfu at 80° C. with various incubation times.

Both InTaq and InPfu were readily expressed after IPTG induction. After harvesting the cells, the target proteins could be clearly identified in the whole cell lysate. These results have demonstrated that the insertion of PI-PfuI mini intein does not compromise the protein expression of both DNA polymerases. Since both the intein and the DNA polymerases are thermally stable, heat treatment was used before affinity chromatography, which denatured the majority of *E. coli* proteins. Affinity chromatography targeting His6 tag was then conducted to purify intein-containing DNA polymerases, which resulted in highly purified InTaq and InPfu. The fusion proteins were then further purified by ion-exchange chromatography and the final products were over 90% purity (FIG. 2A).

Temperature-Induced Protein Splicing of InTaq and InPfu

For functional auto hot start DNA polymerases, the inserted intein should be able to remove itself from the fusion proteins by protein splicing after a certain temperature is reached (FIG. 1A). To examine whether the inserted PI-PfuI mini intein is capable of temperature controlled protein splicing, InTaq and InPfu were incubated at various temperatures for different lengths of time.

The results (FIG. 2B-D) have shown that the protein splicing of the inserted PI-PfuI mini intein barely happened under 40° C. No detectable protein splicing products (Taq or Pfu DNA polymerase) were found even after 24 h incubation at 21° C. for both InTaq and InPfu (FIG. 2B-D). Protein splicing products were observable above 50° C. after 1 h incubation. About 9% of InTaq and 3% of InPfu were cleaved in this condition (FIG. 2B-D). The protein splicing reached the maximum at 70-80° C. and over 55% of fusion proteins were cleaved after 1 h (FIG. 2B-D). The protein splicing activity was reduced when the temperature was higher than 80° C. A bigger drop in protein splicing activity was observed in InTaq than InPfu. This could due to the differences in the extein consensus sequences in these two fusion proteins. Moreover, Taq DNA polymerase has less thermal stability than Pfu DNA polymerase, which could also contribute to the variance in the observed protein splicing activity. After determining the optimal temperature for protein splicing, the protein splicing reaction of the inserted PI-PfuI mini intein was monitored at 80° C. for both InTaq and InPfu (FIG. 2E). The temporal protein splicing results showed that an observable amount (about 13%) of Taq DNA polymerase and Pfu DNA polymerase have been produced after 5 min incubation. The splicing reaction continued during the 2 h incubation period and over 55% of each fusion protein was spliced (FIG. 2E).

Temperature Controlled Activities by the Fusion Proteins

The inserted PI-PfuI mini intein should be able to inhibit the DNA substrate binding of the fusion proteins at room temperature. After protein splicing is triggered by increased temperature, the inhibition should be released to recover the substrate binding ability and activates DNA polymerases. This temperature-controlled activation is central for the auto hot start DNA polymerase design.

Figure 3:
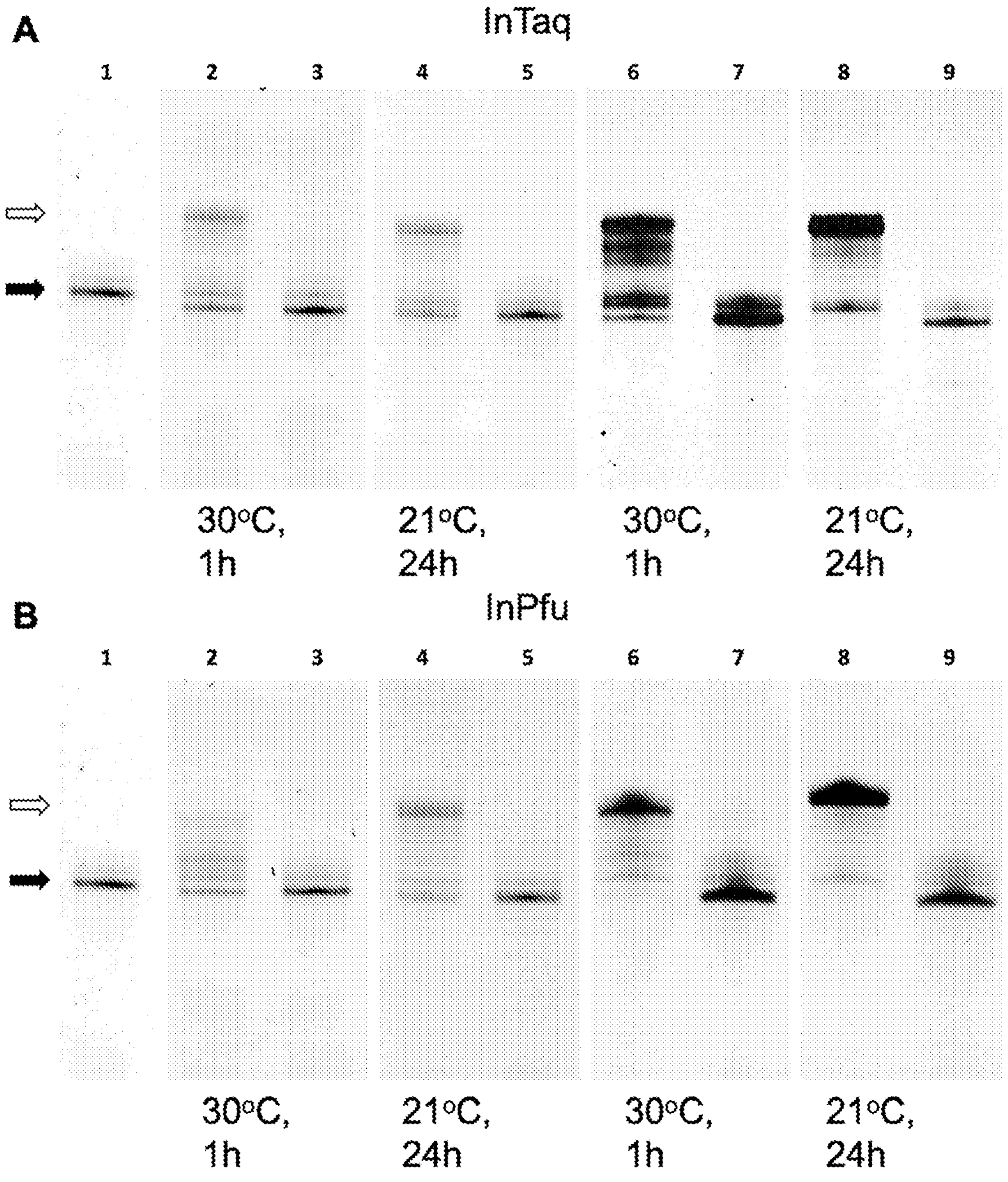
FIG. 3: DNA elongation assay under different conditions. DNA samples are shown on ethidium bromide stained 10% Urea-PAGE. DNA substrate positions are indicated by the bottom left black arrows, and the positions of their elongated products are indicated by the top left empty arrows. Lane 1, control; 2, elongation using activated InTaq (A) or InPfu (B) at 30° C., 1 h; 3, elongation using unactivated InTaq (A) or InPfu (B) at 30° C., 1 h; 4, elongation using activated InTaq (A) or InPfu (B) at 21° C., 24 h; 5, elongation using unactivated InTaq (A) or InPfu (B) at 21° C., 24 h; 6, elongation using wildtype Taq DNA polymerase (A) or Pfu DNA polymerase (B) at 30° C., 1 h; 7, elongation using unactivated InTaq (A) or InPfu (B) at 30° C., 1 h; 8, elongation using wildtype Taq DNA polymerase (A) or Pfu DNA polymerase (B) at 21° C., 24 h; 9, elongation using unactivated InTaq (A) or InPfu (B) at 21° C., 24 h.

To examine whether the fusion proteins are inhibited by the inserted intein, DNA elongation assay was conducted using a hairpin substrate for both InTaq and InPfu under different conditions (FIG. 3). After incubation at 30° C. for 1 hour or 21° C. for 24 hours, the reactions with either InTaq or InPfu did not show obvious elongation products (FIG. 3). However, if InTaq or InPfu was pre-activated by incubation at 80° C. for 5 min, the accumulation of elongation products was observed (FIG. 3). Under the same condition, wildtype Taq DNA polymerase or Pfu DNA polymerase creates a large amount of elongation products (FIG. 3). These results have demonstrated that the PI-PfuI mini intein fusion inhibits the DNA polymerase activity of both InTaq and InPfu at room temperature.

Figure 4:
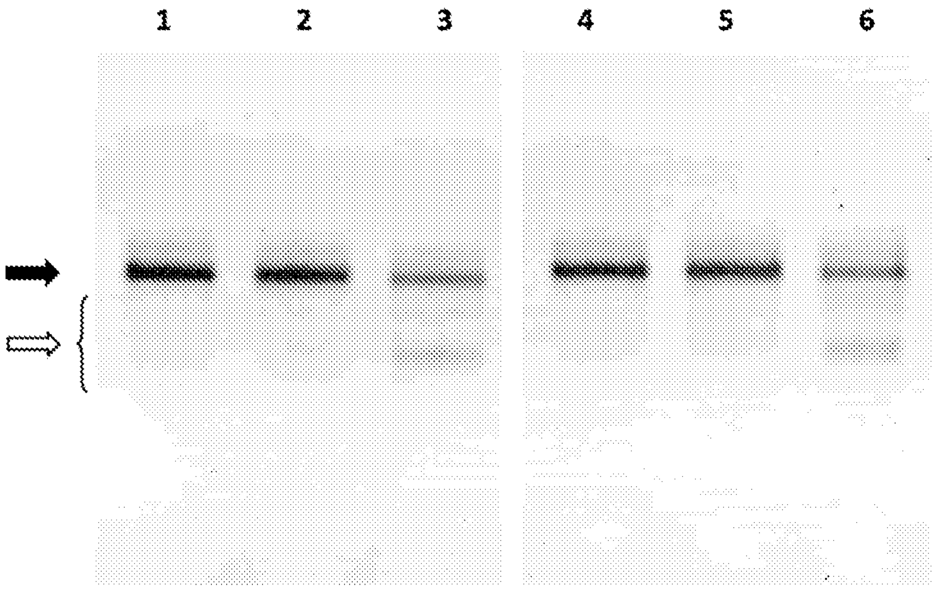
FIG. 4: Exonuclease assay with different enzymes. DNA samples are shown on ethidium bromide stained 10% Urea-PAGE. DNA substrate positions are indicated by the top left black arrow, and the positions of their cleaved products are indicated by the bottom left empty arrow. Lane 1 and 4, control; 2 and 5, cleavage using unactivated InPfu at 50° C., 1 h; 3, cleavage using activated InPfu at 50° C., 1 h; 6, cleavage using wildtype Pfu DNA polymerase at 50° C., 1 h.

Many B family DNA polymerases contain the 3'-5' exonuclease domain, which processively degrades ssDNA or dsDNA. Preventing the binding of the DNA substrate should block the polymerase activity as well as any other activities requiring DNA binding. To test this hypothesis, the exonuclease assay was conducted with intein-containing InPfu and wildtype Pfu DNA polymerase. With a hairpin substrate at 50° C. for 1 h, no DNA cleavage was detected in reactions with InPfu (FIG. 4). However, with pre-activated InPfu or wildtype Pfu DNA polymerase, cleaved DNA products were observed (FIG. 4). The results of elongation assays and exonuclease assays have demonstrated that the inserted intein blocks the binding of the DNA substrate, resulting in the inhibition of DNA polymerase and exonuclease activities.

Auto Hot Start PCR by Auto Hot Start DNA Polymerases

Figure 5:
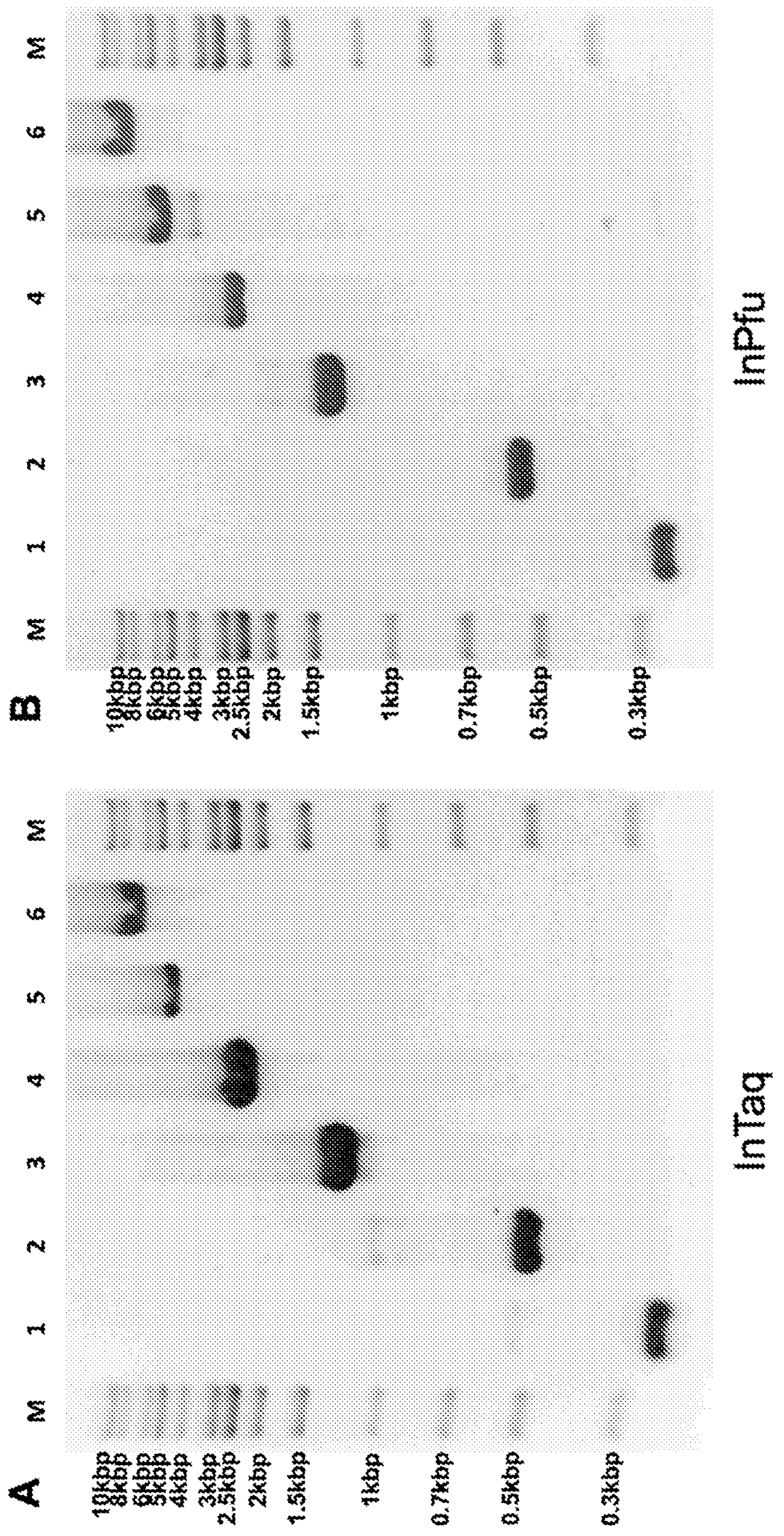
FIG. 5: PCR reactions using InTaq (A) or InPfu (B). PCR amplified products are shown on ethidium bromide stained 1% agarose gel. Lane M, ladder; 1, 0.26 kb DNA product; 2, kb DNA product; 3, 1.4 kb DNA product; 4, 2.5 kb DNA product; 5, 4.5 kb DNA product; 6, 6.1 kb DNA product.

The auto hot start DNA polymerases described herein can suppress catalysis up to 24 hours at room temperature and rapidly regain activity above 50° C. These fusion proteins should also be able to conduct standard DNA amplification reactions such as PCR. To determine the PCR capability of InTaq and InPfu, these proteins were used to amplify a series of substrates following standard PCR protocol with 1 kb/minute amplification steps. DNA templates with lengths from 0.26 kb to 6.1 kb were tested. DNA amplification products were observed for all substrates by PCR (FIG. 5). These results have demonstrated that InTaq and InPfu are capable of DNA amplification using standard PCR protocol and can be used for hot start PCR.

Protein Splicing in the Presence of Common PCR Additives

Figure 6:
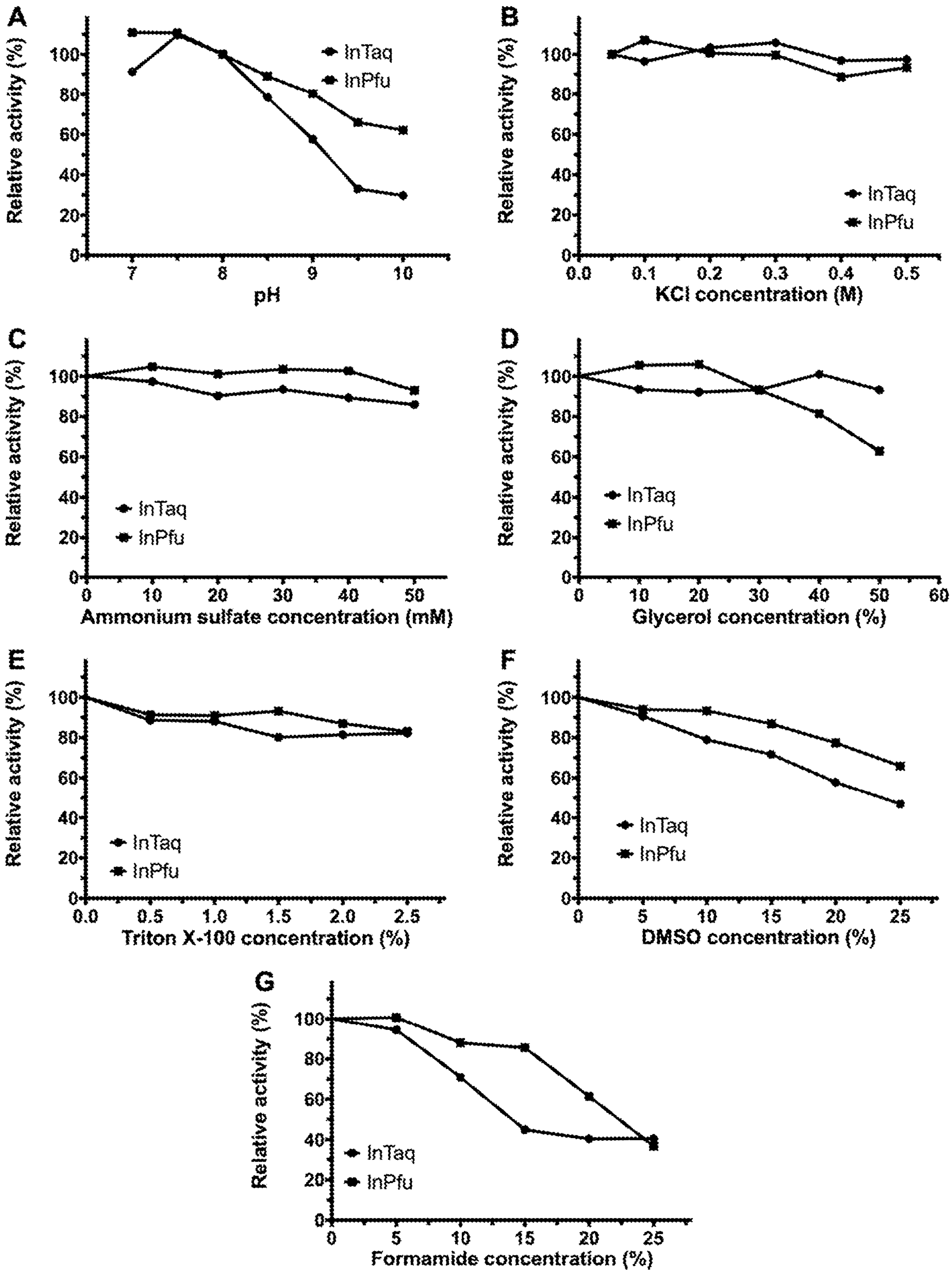
FIG. 6: protein splicing assay of InTaq and InPfu with various conditions and additives. The basic reaction buffer was 25 mM Tris-HCl pH 8.0 and 50 mM KCl with modified conditions and additives as stated below. The reactions were conducted at 80° C. for 1 h. A. protein splicing activity with various pH. B. protein splicing activity with various KCl concentrations. C. protein splicing activity with various ammonium sulfate concentrations. D. protein splicing activity with various glycerol concentrations. E. protein splicing activity with various Triton X-100 concentrations. F. protein splicing activity with various DMSO concentrations. G. protein splicing activity with various formamide concentrations.

PCR reaction buffer is routinely modified to cater to diverse needs. Many additives are used for different reactions. For example, DMSO is a common PCR enhancer to increase the reaction yield and specificity, especially for GC-rich substrates. To test the compatibility of the auto hot start DNA polymerases with different PCR buffers, the protein splicing assay was conducted at 80° C. for 1 hour under various conditions, including different pH, various ionic strengths, and in the presence of multiple common PCR additives, including ammonium sulfate, DMSO, formamide, glycerol, and Triton X-100 (FIG. 6).

The optimal working pH of Taq DNA polymerase, Pfu DNA polymerase, and many other commercial DNA polymerases ranges between 7.0-9.0. The protein splicing results showed that the splicing activity for both InTaq and InPfu was optimal between pH 7.0-8.0, while pH 8.0-9.0 was well tolerated (FIG. 6A). However, the further increase in pH further inhibited protein splicing. Thus, pH is another factor which can be used to control the splicing in this design. Varying ionic strength from 50 mM KCl to 500 mM KCl did not have an obvious effect on the protein splicing activity of both InTaq and InPfu (FIG. 6B). Moreover, up to 50 mM of ammonium sulfate had no obvious effect on the protein splicing of the fusion proteins (FIG. 6C). Up to 50% of glycerol did not affect the protein splicing activity of InTaq (FIG. 6D). InPfu splicing activity was unchanged within the normal working glycerol concentration in PCR (<20%), which decreased when glycerol concentration was higher than 30% (FIG. 6D). The presence of a high concentration of Triton X-100 slightly reduced the protein splicing activity of both InTaq and InPfu, which is about a 15% reduction with 2.5% Triton X-100 (FIG. 6E). Within the common working DMSO concentrations in PCR (<10%), protein splicing activity reduced by about 20% and 7% for InTaq and InPfu, respectively (FIG. 6F). In the presence of 25% DMSO, protein splicing activity of InTaq and InPfu was decreased by about 55% and 35%, respectively (FIG. 6F). In the presence of 25% formamide, the protein splicing activity of InTaq and InPfu was reduced by about 60% and 65%, respectively (FIG. 6G). Within the common working formamide concentrations in PCR (<10%), protein splicing activity was decreased by about 30% and 15% for InTaq and InPfu, respectively (FIG. 6G). These reductions could be due to the denaturation of proteins caused by DMSO or formamide. Thus, none of these additives or conditions induced the intein splicing to compromise the intein-mediated inhibition of the polymerase activity of these auto hot start DNA polymerases. Nonspecific reactions were still inhibited in the presence of common additives or with varying conditions. These results have demonstrated that the auto hot start DNA polymerases described herein are compatible with a wide range of PCR conditions and additives.

Divalent Ion Controlled Activation of Auto Hot Start DNA Polymerases

Figure 7:
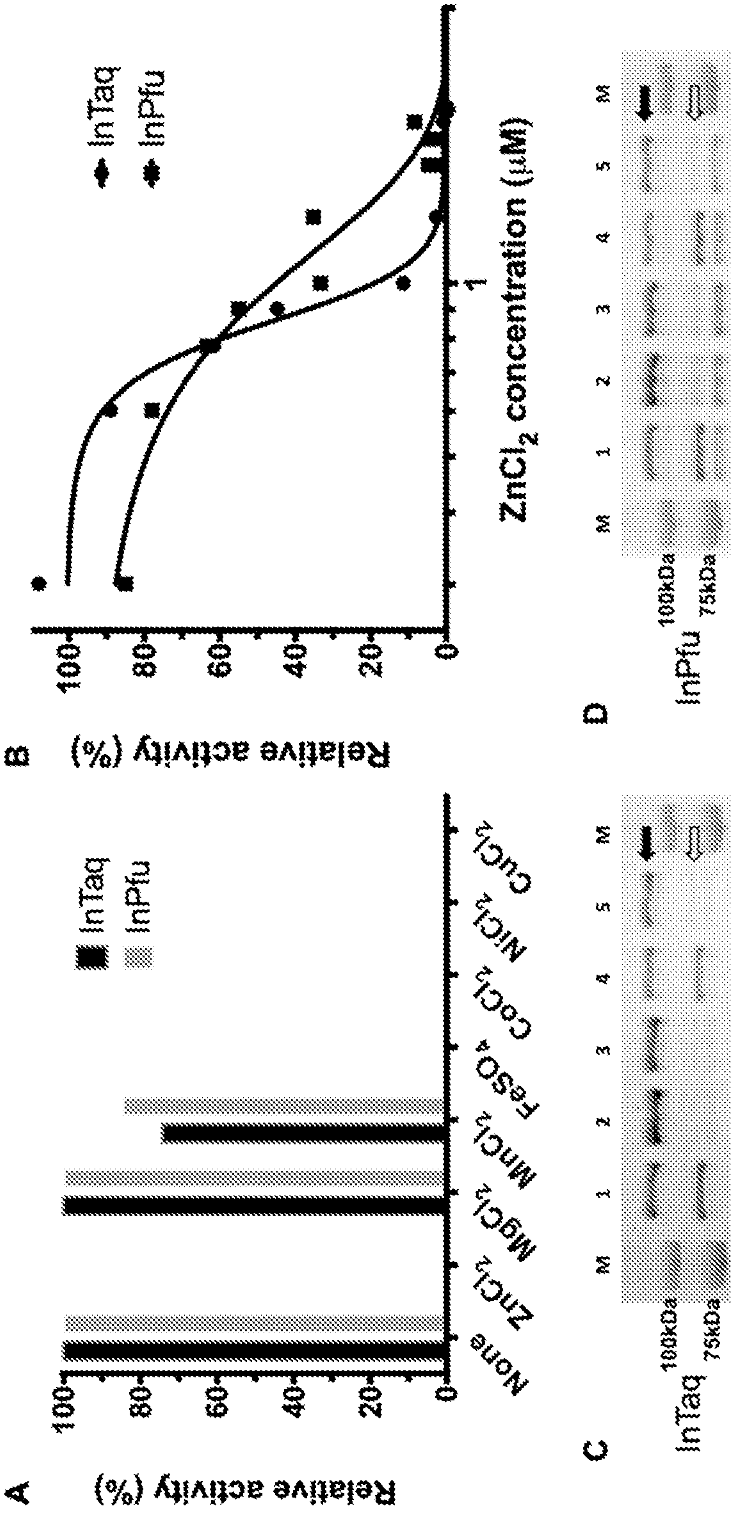
FIG. 7: Protein splicing activity of InTaq and InPfu is regulated by several divalent metal ions. A. protein splicing activity with various divalent metal ions. The reaction buffer was mM Tris-HCl pH 8.0, 50 mM KCl, and 1 mM divalent metal ions. The reactions were done at 80° C. for 1 h. B. protein splicing activity with various $ZnCl_2$ concentrations. Same reaction conditions as A, except $ZnCl_2$ concentrations. The $IC_{50}$ of $Zn^{2+}$ is 6.9±0.7 μM for InTaq and 8.8±4.1 μM for InPfu. C-D. protein splicing of InTaq and InPfu is reversibly inhibited by $ZnCl_2$. Proteins are shown on 8% Coomassie blue stained SDS-PAGE. The positions of InTaq (C) or InPfu (D) are indicated by the top black arrows and the positions of the activated Taq DNA polymerase (C) or Pfu DNA polymerase (D) after protein splicing are indicated by the empty arrows. The reaction buffer was 25 mM Tris-HCl pH 8.0 and 50 mM KCl. Lane 1 is the assay without $ZnCl_2$ at 80° C. for 1 h. After the protein solution with 20 μM $ZnCl_2$ was incubated at 80° C. for 1 h, a 10 μL sample was saved and loaded on Lane 2. Then the rest of the protein solution with 20 μM $ZnCl_2$ was aliquoted to three tubes. The first tube was kept in the same condition. The second tube was mixed with EDTA with a final concentration of 1 mM. The third tube was mixed with 4 volumes of reaction buffer to dilute the $ZnCl_2$ to 4 μM. These three tubes were then incubated at 80° C. for another 1 h. The first tube was loaded on Lane 3. The second tube was loaded on Lane 4. The third tube was loaded on Lane 5. Lane M is the ladder.

Divalent ions reversibly inhibit some inteins, but their effects on PI-PfuI intein or PI-PfuI mini intein have not been investigated. To examine the effect of divalent ions on the auto hot start DNA polymerases, the protein splicing activity of both InTaq and InPfu was tested at 80° C. for 1 hour in the presence of 1 mM common divalent metal ions (FIG. 7A). Among the test divalent ions, $Mg^{2+}$ had no effects on protein splicing activity for both InTaq and InPfu (FIG. 7A). In the presence of $Mn^{2+}$, the activity of PI-PfuI mini intein reduced 25% and 15% in InTaq and InPfu, respectively. In contrast, the fused PI-PfuI mini intein was inhibited by $Zn^{2+}$, $Fe^{2+}$, $Co^{2+}$, $Ni^{+2}$, and $Cu^{2+}$, and no protein splicing products were observed for both fusion proteins (FIG. 7A). In the presence of $Fe^{2+}$, $Co^{2+}$, or $Cu^{2+}$, the amount of fusion proteins decreased, indicating potential precipitation caused by the divalent ions. These results have demonstrated that the protein splicing activity of the inserted PI-PfuI mini intein in the auto hot start DNA polymerases can be inhibited by multiple divalent ions.

$Zn^{2+}$ inhibition of InTaq and InPfu was further investigated by conducting the protein splicing assay at 80° C. for 1 hour with various concentrations of $ZnCl_2$ (FIG. 7B). The $IC_{50}$ of $Zn^{2+}$ is 6.9±0.7 μM for InTaq and 8.8±4.1 μM for InPfu. Therefore, about 20 μM $Zn^{2+}$ is sufficient to inhibit the majority of the fusion proteins (FIG. 7B). To test whether the $Zn^{2+}$ inhibition of the inserted PI-PfuI mini intein is reversible, EDTA was used to chelate 20 μM pre-incubated $Zn^{2+}$ in the protein splicing assay (FIGS. 7C and 7D). The results showed that $Zn^{2+}$ inhibited InTaq and InPfu regained protein splicing activity after EDTA treatment (FIGS. 7C and 7D). However, diluting the reaction to 5 μM final $Zn^{2+}$ concentration did not rescue the inhibited protein splicing activity of the inserted PI-PfuI mini intein, indicating specific binding of $Zn^{2+}$ to the fusion proteins (FIGS. 7C and 7D).

These results have demonstrated that the $Zn^{2+}$ inhibition of both InTaq and InPfu was reversible, providing another method to control auto hot start DNA polymerases by regulating intein splicing.

Example 2

RT-PCR is the reaction used to detect RNA, which is essential for detecting SARS-CoV-2 and other RNA-based viruses. Usually, such a reaction requires two enzymes: reverse transcriptase synthesizes DNA from RNA, which is then amplified by DNA polymerase in PCR. If DNA polymerases can conduct both reactions, it can simplify the reaction and potentially lower reaction time. Moreover, the auto hot start DNA polymerases described herein have the hot start function to enhance accuracy by eliminating non-specific products. Accordingly, the auto hot start polymerases described herein may be developed into a novel single enzyme hot start test kit, such as for SARS-CoV-2 or Influenza.

Materials and Methods

RT-PCR:

The total RNA of 3 ml overnight cultured BL21 (DE3) was extracted using Trizol reagent. The purified RNA was dissolved in DEPC-water. 10 μg RNA was further treated by DNase I in 100 μl reaction at 37° C. for 1 h. The reaction was stopped by the addition of 5 mM EDTA followed by incubation at 75° C. for 10 min. 1 μl Dnase I treated RNA was added to 25 μl RT-PCR reaction containing 60 mM Tris-HCl pH 8.0, 2 mM $(NH_4)_2SO_4$, 40 mM KCl, 2 mM $MgCl_2$, 0.2 mM dNTPs each, 0.2 μM each primer, and 5 μg/ml InTaq DNA polymerase. The forward primer is 5'-CTCTTGCCATCGGATGTGCCCA-3' (SEQ ID NO: 248). The reverse primer is 5'-CCAGTGTGGCTGGTCATCCTCTCA-3' (SEQ ID NO: 249). A 105 bp fragment can be amplified using these two primers from *E. coli* rrsA gene or 16S rRNA. To evaluate possible genomic DNA containments, 1 μl Dnase I treated RNA or 1 μl BL21 (DE3) cell culture was added to 25 μl PCR reaction containing 120 mM Tris-HCl pH 8.8, 10 mM KCl, 6 mM ammonium sulfate, 1.5 mM $MgCl_2$, 0.1% Triton X-100, 0.001% BSA, 0.2 mM dNTPs each, 0.2 μM each primer, and 1.25 units Pfu DNA polymerase. The mixtures were loaded onto PCR machine with the following program: first incubation at 80° C. for 1 min, 60° C. for 30 min, and 94° C. for 1 min; followed by 35 thermal cycles of 94° C. for 30 sec and 60° C. for 10 sec. After RT-PCR, 5 μl sample was mixed with loading dye and loaded onto 1% agarose-TBE gel containing ethidium bromide. After electrophoresis, the gel was imaged under ultraviolet light.

HT-RT-PCR:

The MS2 phage (ATCC 15597-B1) was cultured on agar plates according to the protocol from ATCC. The soft agar was scraped off the surface and centrifuged. The supernatant containing phage particles was collected as the stock. 1 μl phage stock was mixed with 9 μl 5 mM EDTA (pH 8.0). The diluted phage solution was used as the input sample. mM EDTA solution was used as the negative control sample. RT-PCR was performed as described above with $MgCl_2$ concentration increased to 4 mM. 1 μl diluted phage solution or EDTA solution was added to the reaction. Two sets of primers were used to detect the MS2 genome RNA.

```
                                              (SEQ ID NO: 250)
Set 1 forward primer is 5'-GGTGATCGCGGTCAGATAAATAGAGA-3'.

                                              (SEQ ID NO: 251)
Set 1 reverse primer is 5'-CAGAGAGGAGGTTGCCAATAAGGCTA-3'.

                                              (SEQ ID NO: 252)
Set 2 forward primer is 5'-ATGGTCCATACCTTAGATGCGTTAGCA-3'.

                                              (SEQ ID NO: 253)
Set 2 reverse primer is 5'-GTCGACGAGAACGAACTGAGTAAAGTTA-3'.
```

Set 1 and Set 2 primers amplify 112 bp and 113 bp fragments, respectively. The mixtures were loaded onto PCR machine with the following program: first incubation at 95° C. for 5 min, 60° C. for 30 min, and 94° C. for 1 min; followed by 35 thermal cycles of 94° C. for 30 sec and 60° C. for 10 sec. After RT-PCR, 5 μl sample was mixed with loading dye and loaded onto 1% agarose-TBE gel containing ethidium bromide. After electrophoresis, the gel was imaged under ultraviolet light.

Results

Figure 8:
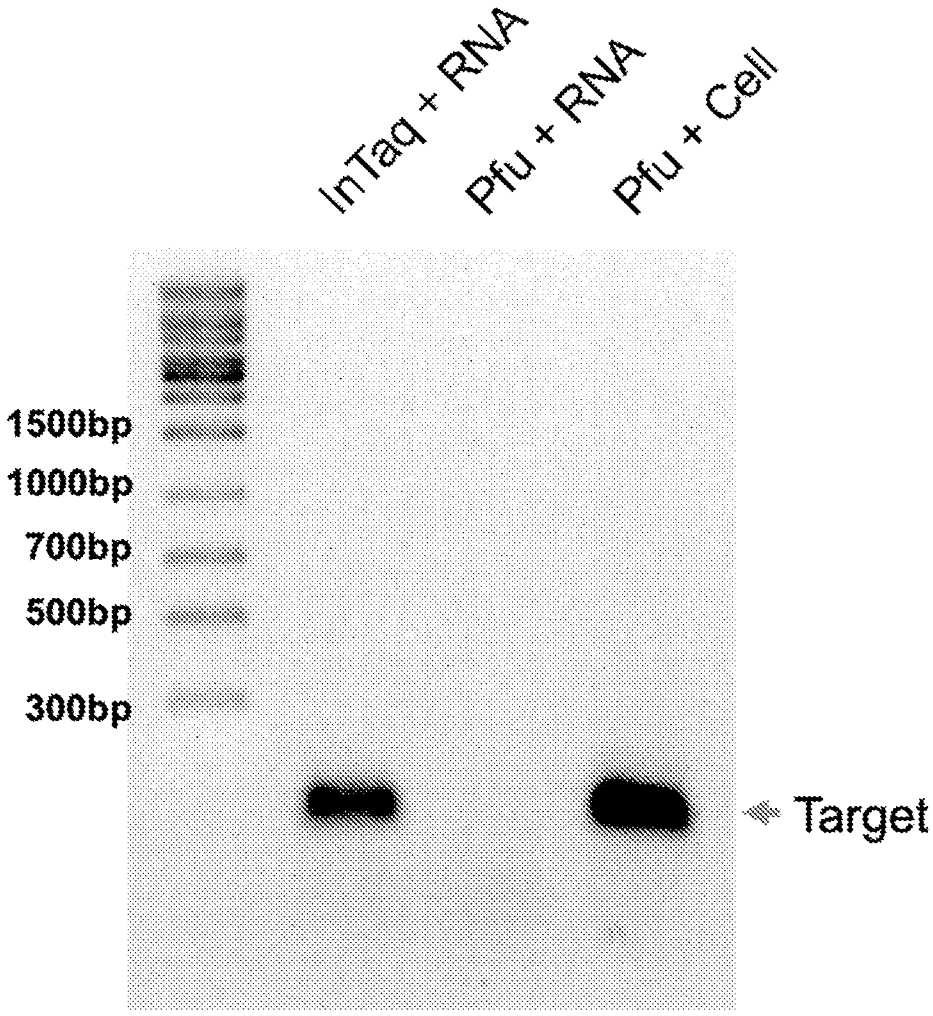
FIG. 8. RT-PCR amplification of a 105 bp fragment of 16S rRNA from *E. coli* total RNA with InTaq. Pfu DNA polymerase was used as a control.

RT-PCR:

Multiple A family DNA polymerases also have reverse transcriptase activity, including Tth, Bst, and Taq DNA polymerases. Therefore, InTaq DNA polymerase should be able to catalyze the single enzyme hot start RT-PCR. To test this hypothesis, we used InTaq DNA polymerase to amplify a 105 bp fragment of 16S rRNA from *E. coli* total RNA under a published condition. The results showed that a single target DNA was amplified from the total RNA sample (FIG. 8). As the control, Pfu DNA polymerase only amplified the target from the genomic DNA but not from our total RNA sample, demonstrating no DNA containments in the RNA sample. These results have demonstrated that InTaq DNA polymerase can be used for the single enzyme hot-start RT-PCR, which has great potential for simplified viral RNA detection.

Figure 9:
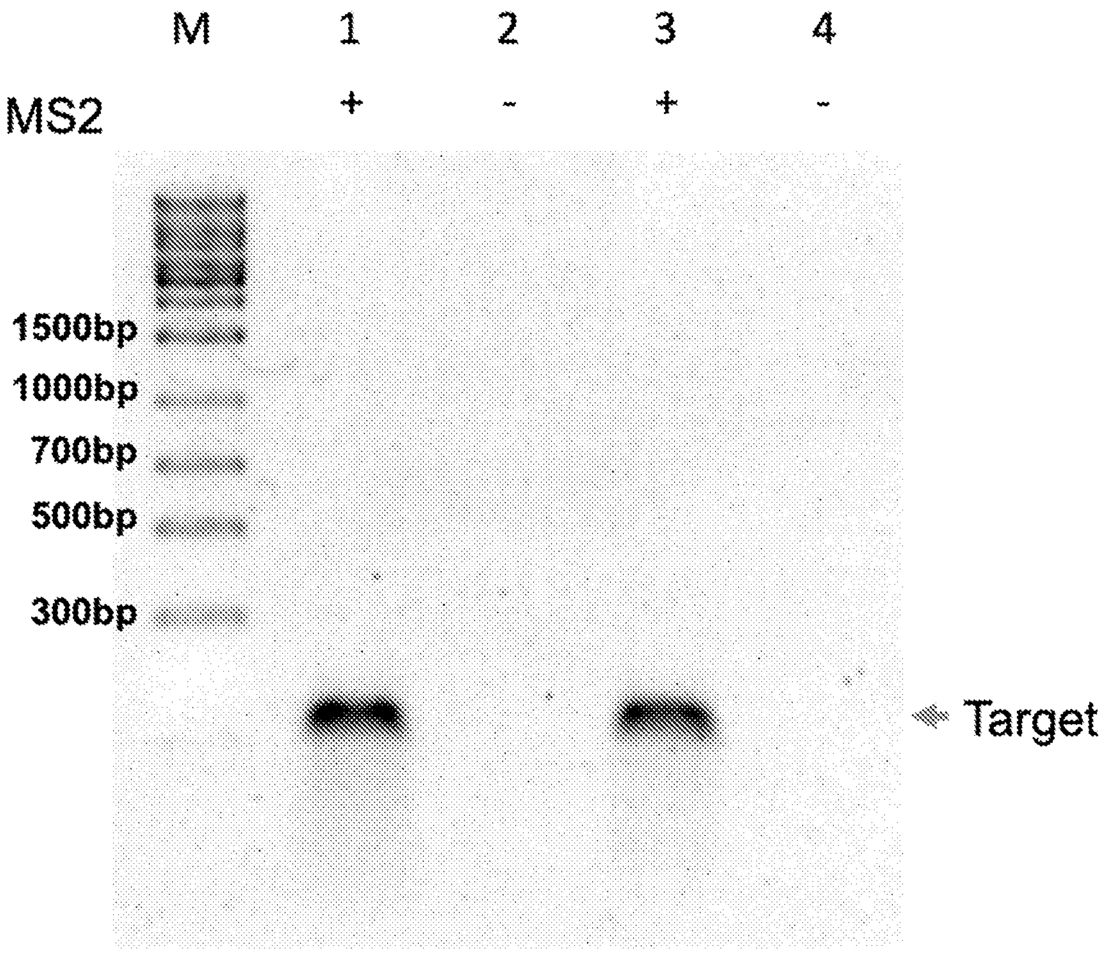
FIG. 9. Detection of MS2 phage viral RNA using HT-RT-PCR with InTaq. Lane 1 and 2 are reactions containing the primer set 1 that can amplify a 112 bp fragment from MS2 genome. Lane 3 and 4 are reactions containing the primer set 2 that can amplify a 113 bp fragment from MS2 genome. Diluted solution containing MS2 phage (1 and 3) or EDTA solution (2 and 4) was added directly into the HT-RT-PCR reaction without separate RNA extraction.

HT-RT-PCR:

Heat-treated RNA extraction is common for detecting viral RNA for RNA viruses. It is usually conducted as a separate step prior to RT-PCR. Since InTaq is thermally stable, it should be able to withstand heat-treated RNA extraction. Thus, heat-treated RNA extraction can be combined with RT-PCR (HT-RT-PCR) to accelerate the RNA virus detection procedure. To test this hypothesis, diluted MS2 phage was added directly to RT-PCR reaction containing InTaq DNA polymerase. Instead of a separate RNA extraction step, the reaction was heated at 95° C. for 5 min followed by standard RT-PCR. The target viral RNA was successfully amplified using this method (FIG. 9). These results have demonstrated that InTaq DNA polymerase can be used for the single enzyme one step hot-start HT-RT-PCR, which has great potential for shortening viral RNA detection procedure. Moreover, since there is no sample transfer between heat-treated RNA extraction and RT-PCR, the potential loss of RNA sample during transfer is minimized in HT-RT-PCR.

All references, including publications, patent applications, and patents, cited herein are hereby incorporated by reference to the same extent as if each reference were individually and specifically indicated to be incorporated by reference and were set forth in its entirety herein.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (253 sequences)

SEQ ID NO: 1 - protein, 1010 aa, Artificial sequence
  synthetic
MLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGGCIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGSGHHHHHHGSGLEVVRHITTTNEPRTFYDLTVENYQNYLAGENGMIFVHNTGKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 2 - protein, 832 aa, Artificial sequence [sequence omitted]

SEQ ID NO: 3 - protein, 829 aa, Artificial sequence
  synthetic
MLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGGTGKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPDLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 4 - protein, 454 aa, Artificial sequence
  synthetic
CIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGEDYKFIFDYWLAGFIAGDGCFDKYHSHVKGHEYIYDRLRIYDYRIETFEIINDYLEKTFGRKYSIQKDRNIYYIDIKARNITSHYLKLLEGIDNGIPPQILKEGKNAVLSFIAGLFDAEGHVSNKPGIELGMVNKRLIEDVTHYLNALGIKARIREKLRKDGIDYVLHVEEYSSLLRFYELIGKNLQNEEKREKLEKVLSNHKGGNFGLPLNFNAFKEWASEYGVEFKTNGSQTIAIINDERISLGQWHTRNRVSKAVLVKMLRKLYEATKDEEVKRMLHLIEGLEVVRHITTTNEPRTFYDLTVENYQNYLAGENGMIFVHN

SEQ ID NO: 5 - protein, 181 aa, Artificial sequence
  synthetic
CIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGSGHHHHHHGSGLEVVRHITTTNEPRTFYDLTVENYQNYLAGENGMIFVHN

SEQ ID NO: 6 - protein, 171 aa, Artificial sequence
  synthetic
CIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGGLEVVRHITTTNEPRTFYDLTVENYQNYLAGENGMIFVHN

SEQ ID NO: 7 - protein, 6 aa, Artificial sequence
  synthetic
HHHHHH

SEQ ID NO: 8 - protein, 2 aa, Artificial sequence
  synthetic
SG

SEQ ID NO: 9 - protein, 2 aa, Artificial sequence
  synthetic
GS

SEQ ID NO: 10 - protein, 958 aa, Artificial sequence
  synthetic
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGGGCIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGSGHHHHHHGSGLEVVRHITTTNEPRTFYDLTVENYQNYLAGENGMIFVHNTGKISNRAILAEEYDPKKHKYDAEYYIENQVLPAVLRILEGFGYRKEDLRYQKTRQVGLTSWLNIKKS

SEQ ID NO: 11 - protein, 775 aa, Artificial sequence
  synthetic
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTRQVGLTSWLNIKKS

SEQ ID NO: 12 - protein, 777 aa, Artificial sequence
  synthetic
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGGGTGKISNRAILAEEYDPKKHKYDAEYYIENQVLPAVLRILEGFGYRKEDLRYQKTRQVGLTSWLNIKKS

SEQ ID NO: 13 - protein, 382 aa, Artificial sequence
  synthetic
CVVGDTRILTPEGYLKAEEIFSLAKERGKKEAVAVEGIAEEGEPYAYSVEILLPGEEKVEYETVHGKVLAVADPVAVPAYVWKVGRKKVARVKTKEGYEITATLDHKLMTPEGWKEVGKLKEGDKILLPRFEVEEEFGSESIGEDLAFVLGWFIGDGYLNVNDKRAWFYFNAEKEEEIAVRIRDILVKHFGIKAELHRYGNQIKLGVRGEAYRWLENIVKNNEKRIPEIVYRLKPREIAAFLRGLFSADGYVDKDMAIRLTSKSRELLREVQDLLLLFGILSKIYEKPYESEFHYTTKNGEERIYRSKGYYELVITNYSRKLFAEKIGLEGYKMEKLSLKKTKVDQPIVTVESVEVLGEEIVYDFTVPNYHMYISNGFMSHN

SEQ ID NO: 14 - protein, 182 aa, Artificial sequence
  synthetic
CVVGDTRILTPEGYLKAEEIFSLAKERGKKEAVAVEGIAEEGEPYAYSVEILLPGEEKVEYETVHGKVLAVADPVAVPAYVWKVGRKKVARVKTKEGYEITATLDHKLMTPEGWKEVGKLKEGDKILLPRFEVEEEFGSESTKVDQPIVTVESVEVLGEEIVYDFTVPNYHMYISNGFMSHN

SEQ ID NO: 15 - protein, 423 aa, Artificial sequence
  synthetic
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 16 - protein, 161 aa, Artificial sequence
  synthetic
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEELGEAFADPGLEALAEGQVLWDPIVAVEPAGKARTFDLRVPPFANFVSEDLVVHN

SEQ ID NO: 17 - protein, 98 aa, Artificial sequence
  synthetic
SIMDTEIEVIENGIKKKEKLSDLFNKYYAGFQIGEKHYAFPPDLYVYDGERWVKVYSIIKHETETDLYEINGITLSANHLVLSKGNWVKAKEYENKNN

SEQ ID NO: 18 - protein, 30 aa, Artificial sequence
  synthetic
MRYLGKKRVILYDLSTESGKFYVNGLVLHN

SEQ ID NO: 19 - protein, 130 aa, Artificial sequence
  synthetic
SIMDTEIEVIENGIKKKEKLSDLFNKYYAGFQIGEKHYAFPPDLYVYDGERWVKVYSIIKHETETDLYEINGITLSANHLVLSKGNWVKAKEYENKNNGGMRYLGKKRVILYDLSTESGKFYVNGLVLHN

SEQ ID NO: 20 - protein, 537 aa, Artificial sequence
  synthetic
SLLPEEWIPVVENGKVKLVRIGEFVDGLMKDEKGRAKRDGNTEVLEVSGIRAVSFDRKTKKARLMPVKAVIRHRYSGDVYKITLSSGRKITVTKGHSLFAYRNGELVEVPGEEIKAGDLLAVPRRVHLPERYERLDLVELLLKLPEEETEDIILTIPAKGRKNFFKGMLRTLRWIFGEEKRPRTARRYLRHLEGLGYVKLRKIGYEIIDREGLKRYRKLYERLAEVVRYNGNKREYLIEFNAVRDVISLMPEEELNEWQVGTRNGFRIKPLIEVDEDFAKLLGYYVSEGYAGKQRNQKNGWSYTVKLYNEDERVLDDMENLAREFFGKARRGRNYVEIPRKMAYIIFESLCGTLAENKRVPEVIFTSPEDVRWAFLEGYFIGDGDVHPSKRVRLSTKSELLANGLVLLLNSLGVSAVKLGHDSGVYRVYVNEELPFTGYKKKKNAYYSHVIPKEVLEETFGKVFQRNMSYEKFQELVESEKLEGEKAKRIEWLISGDIILDKVVEVKKMNYEGYVYDLSVEEDENFLAGFGFLYAHN

SEQ ID NO: 21 - protein, 173 aa, Artificial sequence
  synthetic
SLLPEEWIPVVENGKVKLVRIGEFVDGLMKDEKGRAKRDGNTEVLEVSGIRAVSFDRKTKKARLMPVKAVIRHRYSGDVYKITLSSGRKITVTKGHSLFAYRNGELVEVPGEEIKAGDLLAVPRRVHLPESGDIILDKVVEVKKMNYEGYVYDLSVEEDENFLAGFGFLYAHN

SEQ ID NO: 22 - protein, 371 aa, Artificial sequence
  synthetic
CHPADTKVIVKGKGVVNISEVREGDYVLGIDGWQKVQRVWEYDYEGELVNINGLKCTPNHKLPVVRRTERQTAIRDSLAKSFLTKKVKGKLITTPLFEKIGKIEREDVPEEEILKGELAGIILAEGTLLRKDVEYFDSSRGKKRVSHQYRVEITVGAQEEDFQRRIVYIFERLFGVTPSVYRKKNTNAITFKVAKKEVYLRVREIMDGIENLHAPSVLRGFFEGDGSVNKVRKTVVVNQGTNNEWKIEVVSKLLNKLGIPHRRYTYDYTEREKTMTTHILEIAGRDGLILFQTIVGFISTEKNMALEEAIRNREVNRLENNAFYTLADFTAKTEYYKGKVYDLTLEGTPYYFANGILTHNSLYPSIIISHN

SEQ ID NO: 23 - protein, 172 aa, Artificial sequence
  synthetic
CHPADTKVIVKGKGVVNISEVREGDYVLGIDGWQKVQRVWEYDYEGELVNINGLKCTPNHKLPVVRRTERQTAIRDSLAKSFLTKKVKGKLITTPLFEKIGKIEREDVPEEENREVNRLENNAFYTLADFTAKTEYYKGKVYDLTLEGTPYYFANGILTHNSLYPSIIISHN

SEQ ID NO: 24 - protein, 389 aa, Artificial sequence
  synthetic
SVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVKLWELIGLLVGDGNWGGQSNWAKYYVGLSCGLDKAEIERKVLNPLREASVISNYYDKSKKGDVSILSKWLAGFMVKYFKDENGNKAIPSFMFNLPREYIEAFLRGLFSADGTVSLRRGIPEIRLTSVNRELSDAVRKLLWLVGVSNSLFTETKPNRYLEKESGTHSIHVRIKNKHRFADRIGFLIDRKSTKLSENLGGHTNKKRAYKYDFDLVYPRKIEEITYDGYVYDIEVEGTHRFFANGILVHN

SEQ ID NO: 25 - protein, 204 aa, Artificial sequence
  synthetic
SVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVDRKSTKLSENLGGHTNKKRAYKYDFDLVYPRKIEEITYDGYVYDIEVEGTHRFFANGILVHN

SEQ ID NO: 26 - protein, 185 aa, Artificial sequence
  synthetic
CFPGDTRILVQIDGVPQKITLRELYELFEDERYENMVYVRKKPKREIKVYSIDLETGKVVLTDIEDVIKAPATDHLIRFELEDGRSFETTVDHPVLVYENGRFIEKRAFEVKEGDKVLVSELELVEQSSSSQDNPKNENLGSPEHDQLLEIKNIKYVRANDDFVFSLNAKKYHNVIINENIVTHQ

SEQ ID NO: 27 - protein, 166 aa, Artificial sequence
  synthetic
CFPGDTRILVQINGTPQRVTLKELYELFDEEHYESMVYVRKKPKVDIKVYSFNPEEGKVVLTDIEEVIKAPATDHLIRFELELGSSFETTVDHPVLVYENGKFVEKRAFEVREGNIIIIIDESTLEPLKVAVKKIEFIEPPEDFVFSLNAKKYHTVIINENIVTHQ

SEQ ID NO: 28 - protein, 166 aa, Artificial sequence
  synthetic
CFPGETRILVQIDGFPQRITLKELYELFEDEHYENMVYVRKKPKADIKVYSFDPETGKVVLTDIEDVIKAPITDHLIRFELELGRSFETTIDHPVLVYENGKFFKKRAFEVKESDIMVVIDESDSKPLKITIKKIEFVKPTGDFVFSLNAKNYHNVLINENIVTHQ

SEQ ID NO: 29 - protein, 164 aa, Artificial sequence
  synthetic
CFPGDTRILVQIDGKPARITLRELYELFEGESYENMVYVRRKPKRDVKVYSFDPERGKVVLTDIEDVIKAPSTDHLIRFELELGRSFETTVDHPVLVYENGKFVEKRAFEVKEGELIGVYENDSIKPFKIERIKYVKPKDDFVFSLNAKSYHNVLINENVVTHQ

SEQ ID NO: 30 - protein, 474 aa, Artificial sequence
  synthetic
CFPGDTRILVQINGLPQRITLRELYDLFEDERYENMAYVRKKPKADVKVYSFDPESGKVVLTDIEDVIKAPSTDHLIRFELELGRSFETTVDHPVLVYENGKFVEKRAFEVREGDRILVPNLKLPEKNIDYLDLLKEFSREEFAHLHDRIMVRGIAEWLRSVEADVKEDYLRRDSIPLSVLLRVLTEKEISIEEVPSCWLGFKRDKVRIKRFVPLKPLLRVVGYYLAEGYARESKSVYQLSFSMAEKEVREDLKRALREAFGDGFGIYERGGKVTVGSRILYLLFTEVLKAGKNAYSKRVPSLVFTLPREAVAEMLKAYFEGDGSALKSVPRVVAYSVNKALLEDIETLLLAKFGIRGYYTFDNNANRGNARGRLYHVERGTEAPVSKVYALNIAGEHYHRFFNSIGFVSERKNSIYELHAEKSPAQDRYSSQNGWLVKVRRIEYITPKDDFVFSLNAKKYHNVIINESIVTHQ

SEQ ID NO: 31 - protein, 180 aa, Artificial sequence
  synthetic
CFPGDTRILVQINGLPQRITLRELYDLFEDERYENMAYVRKKPKADVKVYSFDPESGKVVLTDIEDVIKAPSTDHLIRFELELGRSFETTVDHPVLVYENGKFVEKRAFEVREGDRILVPNLKLPEKNKSPAQDRYSSQNGWLVKVRRIEYITPKDDFVFSLNAKKYHNVIINESIVTHQ

SEQ ID NO: 32 - protein, 475 aa, Artificial sequence
  synthetic
CFPGDTRILVQLNGMPQRITLRELYELFEEESYENMAYVRKKPKVDIKVYSFDEESGKVVLTDIEDVIKLPSTDHLIRFELELGRSFETTVDHPVLVYENGRFIKKRAFEVKEGDLILVPKIEFPEEDIDSIDLLEEFSKDEFKELRERIMVRGIAEWLMKIGAEVNPDYIRRNSIPLAVLLEVLKEKGLSIKDVPDCYIGFKPDHVKIRRFVPIGPLLRLIGYYLAEGYARESDSVYQISFSNGDEEVREDIKRALRKAFGDGFGIYERGEKITVGSRVIYLLFTRVLKIGKGAKDKRVPAFVFKLPKEKVRHLLQAYFEGDGTAIKSRPMIVVYSVNKPLLEDIDTLMIAKFNLYASWGVDKNANSRPGNIVQRYHEHRGRRVPVSTVYRLDYYGIQAKRFFEEIDFISERKNSVVNAWTNHKFQPYRRANEMGILVRVRRVEYVKPPEEWVYSLSVAKYHTVIVSDNITTSN

SEQ ID NO: 33 - protein, 185 aa, Artificial sequence
  synthetic
CFPGDTRILVQLNGMPQRITLRELYELFEEESYENMAYVRKKPKVDIKVYSFDEESGKVVLTDIEDVIKLPSTDHLIRFELELGRSFETTVDHPVLVYENGRFIKKRAFEVKEGDLILVPKIEFPEEDIDSTNHKFQPYRRANEMGILVRVRRVEYVKPPEEWVYSLSVAKYHTVIVSDNITTSN

SEQ ID NO: 34 - protein, 537 aa, Artificial sequence
  synthetic
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHN

SEQ ID NO: 35 - protein, 173 aa, Artificial sequence
  synthetic
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPENGDIVLDRVVEIKREYYDGYVYDLSVDEDENFLAGFGFLYAHN

SEQ ID NO: 36 - protein, 168 aa, Artificial sequence
  synthetic
CVDYDTEVLLGDGRKRKIGEIVEEAIKKAEKEGKLGRVDDGFYAPINLELYALDVRTLKVRKVKADIAWKRTTPEKMLRIRTKRGREIRVTPTHPFFTLEEGRIKTKKAYELKVGEKIATPREEAPEAEIFWDEVVEIEEYKPNNSWVYDLQVPEHHNFIANGIFVHN

SEQ ID NO: 37 - protein, 164 aa, Artificial sequence
  synthetic
CVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHN

SEQ ID NO: 38 - protein, 140 aa, Artificial sequence
  synthetic
CVAPDSIIKTNLGQFKIGELVEKAIPEKVQDYKSVNAEKLGLYIKTLDGDMRVLRLWKLRAPEKLIRIEGDGLSITVTPETKLLTPNGWVEARNVDGEVVTENGPVKVSKQEIESPHDYVYDLTVEGSHSFIANGFVVHN

SEQ ID NO: 39 - protein, 335 aa, Artificial sequence
  synthetic
SVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKELPNIEEDIEIDKKFSKILGYIIAEGYYDDKKIVLSYDYNEKEFINETIDYFKSLNSDITIYSKDLNIQIEVKNKKIINLLKKLRVKNKRIPSIIFKSPYEIKKSFIDGIFNGKDAKVFVSKELAEDVIFLLLQIKENATINKKSINDIEVYEVRRITNIYTNRKLEKLINSDFIFLKIKEINKVEPTSGYAYDLTVPNAENFVAGFGGFVLHN

SEQ ID NO: 40 - protein, 180 aa, Artificial sequence
  synthetic
SVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKRITNIYTNRKLEKLINSDFIFLKIKEINKVEPTSGYAYDLTVPNAENFVAGFGGFVLHN

SEQ ID NO: 41 - protein, 335 aa, Artificial sequence
  synthetic
SVDYSEPIIIKEKGEIKVVKIGELIDEIIKNSKNVRKDGILEIARCKDVEVIAFDSNYKFKFMPVSEVSRHPVSEMFEIVVEGNKKVRVTGSHSVFTVKDNEVVPIRVDDLRVGDILVLAKELPNIEEENAIDKKFAKILAYIVSEGYYNEEKLIFSFNCNKREVIDEVISYFKSLKSEISIYNKNSDIQIEVKDKEIINILKKLGIENKRVPSIIFKSPYGIKKSFIDGLFNGKDTKIFTSKELAEDAIFLLLQIKENAILNKKIIKGISVYEVKRIPNIYNNRKLEKLINSDFIFLKIKKINKVEPTNGYAYDLTVPNAENFIAGFGGFVLHN

SEQ ID NO: 42 - protein, 180 aa, Artificial sequence
  synthetic
SVDYSEPIIIKEKGEIKVVKIGELIDEIIKNSKNVRKDGILEIARCKDVEVIAFDSNYKFKFMPVSEVSRHPVSEMFEIVVEGNKKVRVTGSHSVFTVKDNEVVPIRVDDLRVGDILVLAKELPNIEENRKLEKLINSDFIFLKIKKINKVEPTNGYAYDLTVPNAENFIAGFGGFVLHN

SEQ ID NO: 43 - protein, 172 aa, Artificial sequence
  synthetic
CFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHN

SEQ ID NO: 44 - protein, 168 aa, Artificial sequence
  synthetic
CFAKDTTVYYENDDVAHVESIEEMYNKYATKNGEIPFDNGFAVPLEVVSVYTFNIKTRKVEKTKVSYIYKEKVSTLVKLKLSTGIELKVTQSHPVLVFKDGLKWIKASEVQIGDRVVGIGEVPPKSEVNLRFHQVESVEIFDYNDYVYDLVVPETHNFIAPNGLILHN

SEQ ID NO: 45 - protein, 168 aa, Artificial sequence
  synthetic
ALAYDEPIYLSDGNIINIGEFVDKFFKKYKNSIKKEDNGFGWIDIGNENIYIKSFNKLSLIIEDKRILRVWRKKYSGKLIKITTKNRREITLTHDHPVYISKTGEVLEINAEMVKVGDYIYIPKNNTINLDEVIKVETVDYNGHIYDLTVEDNHTYIAGKNEGFAVSN

SEQ ID NO: 46 - protein, 260 aa, Artificial sequence
  synthetic
CVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHN

SEQ ID NO: 47 - protein, 182 aa, Artificial sequence
  synthetic
CVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHN

SEQ ID NO: 48 - protein, 195 aa, Artificial sequence
  synthetic
CFHPETNVWFRDESGEWHHDPIETLVEARLDPDTADEDDFGALVQALDGDVFVPSVTEDGEETLQRVEAVSKHPAPDHLLAVETKRGRELTVTPDHSMRRWTGDGIERVDARELTAGDALPAPTQVPGDGETATSELRSESLDGTHPQRRFGDGGSVRTDEVVSVEPVRSSVDHTYSLTVAETNTLVANGLFTGQ

SEQ ID NO: 49 - protein, 134 aa, Artificial sequence
  synthetic
CVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHN

SEQ ID NO: 50 - protein, 198 aa, Artificial sequence
  synthetic
CITGDALVALPEGESVRIADIVPGARPNSDNAIDLKVLDRHGNPVLADRLFHSGEHPVYTVRTVEGLRVTGTANHPLLCLVDVAGVPTLLWKLIDEIKPGDYAVIQRSAFSVDCAGFARGKPEFAPTTYTVGVPGLVRFLEAHHRDPDAQAIADELTDGRFYYAKVASVTDAGVQPVYSLRVDTADHAFITNGFVSHN

SEQ ID NO: 51 - protein, 186 aa, Artificial sequence
  synthetic
CVSGETPVYLADGKTIKIKDLYSSERKKEDNIVEAGSGEEIIHLKDPIQIYSYVDGTIVRSRSRLLYKGKSSYLVRIETIGGRSVSVTPVHKLFVLTEKGIEEVMASNLKVGDMIAAVAESESEARDCGMSEECVMEAEVYTSLEATFDRVKSIAYEKGDFDVYDLSVPEYGRNFIGGEGLLVLHN

SEQ ID NO: 52 - protein, 173 aa, Artificial sequence
  synthetic
CVSGDTPVLLDAGERRIGDLFMEAIRPKERGEIGQNEEIVRLHDSWRIYSMVGSEIVETVSHAIYHGKSNAIVNVRTENGREVRVTPVHKLFVKIGNSVIERPASEVNEGDEIAWPSVSENGDSQTVTTTLVLTFDRVVSKEMHSGVFDVYDLMVPDYGYNFIGGNGLIVLHN

SEQ ID NO: 53 - protein, 454 aa, Artificial sequence
  synthetic
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHN

SEQ ID NO: 54 - protein, 228 aa, Artificial sequence
  synthetic
CFAKGTNVLMADGSIECIENIEVGNKVMGKDGRPREVIKLPRGSETMYSVVQKSQHRAHKSDSSREMPELLKFTCNATHELVVRTPRSVRRLSRTIKGVEYFEVITFEMGQKKAPDGRIVELVKEVSKSYPVSEGPERANELVESYRKASNKAYFEWTIEARDLSLLGSHVRKATYQTYAPIGAAFARECRGFYFELQELKEDDYYGITLSDDSDHQFLLANQVVVHN

SEQ ID NO: 55 - protein, 123 aa, Artificial sequence
  synthetic
CLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 56 - protein, 36 aa, Artificial sequence
  synthetic
MVKVIGRRSLGVQRIFDIGLPQDHNFLLANGAIAAN

SEQ ID NO: 57 - protein, 159 aa, Artificial sequence
  synthetic
CLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIKMVKVIGRRSLGVQRIFDIGLPQDHNFLLANGAIAAN

SEQ ID NO: 58 - protein, 102 aa, Artificial sequence
  synthetic
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 59 - protein, 36 aa, Artificial sequence
  synthetic
MIKIATRKYLGKQNVYDIGVERDHNFALKNGFIASN

SEQ ID NO: 60 - protein, 137 aa, Artificial sequence
  synthetic
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNIKIATRKYLGKQNVYDIGVERDHNFALKNGFIASN

SEQ ID NO: 61 - protein, 429 aa, Artificial sequence
  synthetic
CISGDSLISLASTGKRVSIKDLLDEKDFEIWAINEQTMKLESAKVSRVFCTGKKLVYILKTRLGRTIKATANHRFLTIDGWKRLDELSLKEHIALPRKLESSSLQLMSDEELGLLGHLIGDGCTLPRHAIQYTSNKIELAEKVVELAKAVFGDQINPRISQERQWYQVYIPASYRLTHNKKNPITKWLENLDVFGLRSYEKFVPNQVFEQPQRAIAIFLRHLWSTDGCVKLIVEKSSRPVAYYATSSEKLAKDVQSLLLKLGINARLSKISQNGKGRDNYHVTITGQADLQIFVDQIGAVDKDKQASVEEIKTHIAQHQANTNRDVIPKQIWKTYVLPQIQIKGITTRDLQMRLGNAYCGTALYKHNLSRERAAKIATITQSPEIEKLSQSDIYWDSIVSITETGVEEVFDLTVPGPHNFVANDIIVHN

SEQ ID NO: 62 - protein, 154 aa, Artificial sequence
  synthetic
CISGDSLISLASTGKRVSIKDLLDEKDFEIWAINEQTMKLESAKVSRVFCTGKKLVYILKTRLGRTIKATANHRFLTIDGWKRLDELSLKEHIALPRKLESSSLQLSPEIEKLSQSDIYWDSIVSITETGVEEVFDLTVPGPHNFVANDIIVHN

SEQ ID NO: 63 - protein, 429 aa, Artificial sequence
  synthetic
CLAGDSLVTLVDSGLQVPIKELVGKSGFAVWALNEATMQLEKAIVSNAFSTGIKPLFTLTTRLGRKIRATGNHKFLTINGWKRLDELTPKEHLCLPRNLPSSGKQTMTYAEVALLGHLIGDGCTLPRHAIQYTTREIDLAQNVAFLATEVFGDSIVPRISPEREWYQVYLSAAQHLTHSVRNPIAKWLDSLNVFGLRSYEKFVPRELFSQPKELIACFLRHLWSTDGCINLIAGKKPRPIAFYASSSERLAFDVQTLLLRLGINATLRTVPQVGKGRNQYHVIITGKPDLQLFIVHVGAVGQYKLRSLQDIFQHLENSIHNPNRDIIPKDIWKMEVVPAMQAIGFTTRILQASIGVSYCGSTLYKVNLSRERALKVGNIVQSSKLVTLAKSDVYWDEIVSIEYSGEEEVFDLTVPGLHNFVANNIIVHN

SEQ ID NO: 64 - protein, 139 aa, Artificial sequence
  synthetic
CLAGDSLVTLVDSGLQVPIKELVGKSGFAVWALNEATMQLEKAIVSNAFSTGIKPLFTLTTRLGRKIRATGNHKFLTINGWKRLDELTPKEHLALPRNSGSDIYWDEIVSIEYSGEEEVFDLTVPGLHNFVANNIIVHN

SEQ ID NO: 65 - protein, 139 aa, Artificial sequence
  synthetic
ALALDTPLPTPSGWTTMGDVAVGDHLLGPDGEPTRVVADTDVMLGRPCYVVEFSDGTAIVADAQHQWPTEHGVRITANLRAGMHTVVSASGGRGGTALLAPAVQITAVRRRPSVPVRCVEVDNPEHLYLAGPGMVPTHN

SEQ ID NO: 66 - protein, 440 aa, Artificial sequence
  synthetic
CLAEGTRIFDPVTGTTHRIEDVVDGRKPIHVVAAAKDGTLHARPVVSWFDQGTRDVIGLRIAGGAIVWATPDHKVLTEYGWRAAGELRKGDRVAQPRRFDGFGDSAPIPADHARLLGYLIGDGRDGWVGGKTPINFINVQRALIDDVTRIAATLGCAAHPQGRISLAIAHRPGERNGVADLCQQAGIYGKLAWEKTIPNWFFEPDIAADIVGNLLFGLFESDGWVSREQTGALRVGYTTTSEQLAHQIHWLLLRFGVGSTVRDYDPTQKRPSIVNGRRIQSKRQVFEVRISGMDNVTAFAESVPMWGPRGAALIQAIPEATQGRRRGSQATYLAAEMTDAVLNYLDERGVTAQEAAAMIGVASGDPRGGMKQVLGASRLRRDRVQALADALDDKFLHDMLAEELRYSVIREVLPTRRARTFDLEVEELHTLVAEGVVVHN

SEQ ID NO: 67 - protein, 139 aa, Artificial sequence
  synthetic
CLAEGTRIFDPVTGTTHRIEDVVDGRKPIHVVAAAKDGTLHARPVVSWFDQGTRDVIGLRIAGGAIVWATPDHKVLTEYGWRAAGELRKGDRVAVRDVETGELRYSVIREVLPTRRARTFDLEVEELHTLVAEGVVVHN

SEQ ID NO: 68 - protein, 125 aa, Artificial sequence
  synthetic
CLDLKTQVQTPQGMKEISNIQVGDLVLSNTGYNEVLNVFPKSKKKSYKITLEDGKEIICSEEHLFPTQTGEMNISGGLKEGMCLYVKEMMLKKILKIEELDERELIDIEVSGNHLFYANDILTHN

SEQ ID NO: 69 - protein, 537 aa, Artificial sequence
  synthetic
SILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYFIGDGDVHPNKRLRLSTKSELLANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHN

SEQ ID NO: 70 - protein, 170 aa, Artificial sequence
  synthetic
SILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLEGGDVVLDRVESVDVEDYDGYVYDLSVEDNENFLVGFGLVYAHN

SEQ ID NO: 71 - protein, 135 aa, Artificial sequence
  synthetic
CFVAGTMILTATGLVAIENIKAGDKVIATNPETFEVAEKTVLETYVRETTELLHLTIGGEVIKTTFDHPFYVKDVGFVEAGKLQVGDKLLDSRGNVLVVEEKKLEIADKPVKVYNFKVDDFHTYHVGDNEVLVHN

SEQ ID NO: 72 - protein, 171 aa, Artificial sequence
  synthetic
CLQNGTRLLRADGSEVLVEDVQEGDQLLGPDGTSRTASKIVRGEERLYRIKTHEGLEDLVCTHNHILSMYKERFGREGAHSPSAGTSLTESHERVDVTVDDFVRLPQQEQQKYKLFRSTDFVRREQPSASKLATLLHINSIELEEEPTKWSGFVVDKDSLYLRYDYLVLHN

SEQ ID NO: 73 - protein, 403 aa, Artificial sequence
  synthetic
KCVTADTLIDVPGTGERITVEAFVRRQWPVVLSVSADGRVRESRVGAWIDSGVKPVRRVTTRTGRVVETTPHHPFLGVDGWTPLYDLKVGDRIAVPRAVPVFGQRDVLSAERVRLLAYLLAEGGLTQSGPRWTNADPELVQDFRACLAAEFPEVEMMADAWTGIDDRLSRRWQPGERQDRPNPLIGWLRELGVWGQPTDAKRFPAVVWTFTRPSLAAFLRVLLSCDGTLSTLAGKARIEFTVASEGLARDVHHALVRFGIVSKLWRKGERSWRVEITDPRSVADYQLQIGWLGEKALRTIPVSAETRSHVGHPPAGAWAHVRRAAGERTASGFNAHTGRSLPQSRAARYAAVLDDTQLTLLGSDALYWDDIVSIEDVGERQVYDLTVPGDANFIAADICLHNT

SEQ ID NO: 74 - protein, 494 aa, Artificial sequence
  synthetic
KCLAYDAEIVQADGGVKTIEQIVRERRAHLATVGADWRLTWTEPCDYVDDGHKPVFEVTTRLGRRIETTLTHPFLTVHGWQRLEDLAEGDAIGVPRQLPVFGQEPIRDCEVRLLGHLIGDGGLTGSPPRLTSGQEAMTADFLEAVDAFGGVEAKPIRASRRTQSWVVVGAAQARAAARSSFASLVDALIRRSPLTGRAIARNLGVAPATLTYWRQGVNVPDAAMVGLLAGELGVDVGELRPEPVARRNDRNPLQAWLDRLGLAGKSAHEKTVPDCVFRLPREQLARFLNRLFSSDGWVTHLASGQGQIGYTTVSEALARQIQHLLLRFGVLAKLRHRSVRYQDGRRPAWQLDITHAESILTFAEQIGILGKEQRLASVAASVRGRRRQSHTDHIPCEIWQFIDRARGEWTWAELARRAGVASSNIHAYRRGMSRQRLAAFADALGSRELRQLASSDLYWDRIASIRPLGHKQVYDLTIPETHNFIANDVCVHNT

SEQ ID NO: 75 - protein, 439 aa, Artificial sequence
  synthetic
DSVTGDRPVVVRDPGGTVRILPIEDLFARGTTESEVLIAADGDVVASATPGKTRRALDGWDALSVNEDGEAEWQPIAQAIRHNTDKPVVNLQHKFGESTTTRDHSYVVPGEDGLTTVSPDDVAEPYRVSGVPDVEPVEQVDVYEVLRGYEREYEDGRSVGSDNSITKRKQIHADDEYVWFGHEHHRDVDSTVKVKRFVDIDSEDGAALIRLLGAYVPEGSASTGETATSKFGASLAESDREWLAQLQRDYSRLFENTTAGIITSDRRAERTVEYQTDTGGASVTYNDETLKLQMMNELAAVFFREFAGQTSRGKRIPSFVFHLPEEKQDLFLTLLVEGDGSREFPRYTEAYAQRNFDFETTSRELAAGLSMLLTQRGQKHSLKYRDSKDSYTIRTCSTYREGRDPVLTEADHDGYVYDLSVEENENFVDGVGGIVLHNT

SEQ ID NO: 76 - protein, 523 aa, Artificial sequence
  synthetic
LCVTGETRIHTTDGFVPLKQLATQHHPKKVTTETAAAYERELYTVDPTTQSAEVTQSKSSHVWRMPEKHCRRIRTASGKQLEASVNTPVLTVDDAEIKWKPISAIESNDSVVIPQYNNVERSSVSITDIFEFTQEQLKLTEKSITILRTEIVSQYQNIAAAADALNIDVNSVEALITGQPVVSDVIDRVCDAISVSSEDITIHHVIGPTGTAIELPEVLNDDLLYLLGAAFACGNIMTGETCEERWIQFHAPEESIRSHIIDAAVATFGSESIQTDTEQANTVQVISATVTRLFETLGLEQITDAAPREIHPRLTAVSGADAFIRGLFDTGGRIDNKNTPQIAIGTASEPLAEQIQLLLETYGIGSCRDTGDQSHTGTSTTQGQYLTLTGSDAQAYRTTIGTRTDSGSSWDRQVSSSHADSEPSVRSTTTDTRKRTDMHEHEIISAGDVSTVSSVESDGGTPQMPRSNIEPQSIGYDYESSRVNEIQTETVVEAVNTGKKEVFDLTVPNTQNFIGGGIVTHNT

SEQ ID NO: 77 - protein, 433 aa, Artificial sequence
  synthetic
DSVTGDRPVVVRDPSDYIQIVPIKLLFEQATAPEQNMRLTADGAPSVNSELPKERRHLDQWEALSLSDTGETEWQPINQIIRHQTDKEILTLQHEYGESTTTRDHSYITADDGEYVETSPENVDEPLPIPNIASVKTIETIDIYQTLTTDTQAQIGNDTEPDKWLPSADCIHANDEYVWIGTTDKQQDRDDSTPAIPRYIDLTSDTGHALIRFLAVYLSDWSKSTITTTERGQCLHITGPQESALKTCAADADQLFTHITPSIAVDAESNTNTVDSGFRCHIPTTLATTLISAFAGHPAHTKQIPSIVYHLPAAEQSLFIRHLIQAESTPESDGVSGRPQKSDKPILLENEFITTNRELAAGVSMLLTQCGQSYTISKQDTKGAYTIHINNSSSSGCTPTLTETTHSGYVYDLSVATNQNFVDGLGGLVLHNT

SEQ ID NO: 78 - protein, 325 aa, Artificial sequence
  synthetic
KCVTGSTPILTNKGIRQIGEIVGDVDGFAPAPQNLKVCSLTADGSFQYRHPSHVFGKRASGLQRIKTNDGATLTVTPEHKLLIRTGENTNPTWVPAADITAGMHVLRAKNLPIPAETTGSCAASKNASEVSHIGDEYRYHDSLMADVNTRIATLERLIEDYAESRSDGSLKFTLIGAHTPTVSTVSYLLATVGIASRHTSTLIDSEKRVHAIIIDASDTVRLEEMIETDWDTVMADQTTTVTSSSTASTTKTTQSYLSSGETQTCGWIPYADGGVTHPSTQHSPLHADVVTVSESLDAEKRVYDLTVPGVRNYVGGCIPTVMHNT

SEQ ID NO: 79 - protein, 440 aa, Artificial sequence
  synthetic
GCVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHNT

SEQ ID NO: 80 - protein, 216 aa, Artificial sequence
  synthetic
MSIEADESIVIRRDGETELTEIGSFVDTILAADNQETRITDGHEIALAPNGLEVPSLDTDEQIRWKHIEAVSRHASPDEILLIELESGRSIRATKAHSFVTRRDGDVLPVAGETLVVGDVLPTVGSYDHASGSISVPLQSQSVAADGGTVEPNTNITANAERDSASITSAGIIGSATWERISSIETVAPEYEYVYDLSVSGLETFTTGEGVVTHNT

SEQ ID NO: 81 - protein, 457 aa, Artificial sequence
  synthetic
QSLVKDELIFIKDNEKLKICKIGEYINEVMEKYNEKITVNGDTEILYLDEKDEVYTISVNINTGKTEFKRVYALSRHKPHNKIYKVVGKDGTTVSITEDHSLFNYNENGQLVQVKPKEMSHIIRNFDNPYTIEYKIGDLISTEYARSDSKYNSRQNDIPENIEITKELCQFLGLFVAEGSYGTNSIRISTTDDDVVKFIEKFLKNINENITLTIEKENNILFTNKGVYEFIKNVICINSGAPNKNIPEFILKGDKEIKQAFLGGLISGDGYISKDGRVQIYTTSEQLLGQLHILLSGLNMMYSINKVNEEGERVKIKGIESQRNHKLYVIEIAKNSTDVLDEYIIPKCKKDRIKGSDYEQLSYDYRIIKEYLRNIADKKPCDDYAWKSSNRKLKLTTLEKIEEMNPELRDEITKFKLNVPFEIKEIKETDYEEYVYDLSVEDNENFITATGILCHNT

SEQ ID NO: 82 - protein, 388 aa, Artificial sequence
  synthetic
DSVTENTEIIVKINGEIKFMKIKDLFKKVDYAVGEKEYCLLDDVYALTLNDDGKLIWKKVPYVMRHRANKDIYRVWITNTWYVDVTEDHSLIGYLNTTKKRNAKKIGDRFIEIKPNNLGKDVKSLITINNSLVDDKPVNNISIRFWELVGLLIGDGSWGGKTNSAKYYLRLSAGLDKDEIIKKVLEPLKEIGVISNYYLENEKGDIRILSKKLVRFMNKFKDENNKKIIPKFMFKLSKRKIEAFLRGLFSADGTVIVRRGNAEIRFTNTNENIIENVRKLLYLVGISNSVFKENNPNKYKGKVSKTFSYHINIKNKIRFAERVGFILDRKNERLINLNNKWKSTIRNYDFDIARVKKIEKIDYNGYVYDIEVEDTHRFFANGILVHNT

SEQ ID NO: 83 - protein, 548 aa, Artificial sequence
  synthetic
KCLMPHEKVLTEYGEIKIEDLFKIGKEIVEKDELKEIRKLNIKVHTLNENGEIKIINAPYVWKLKHKGKMIKVKLKNWHSITTTPEHPFLTNNGWIKAENIKKGMYVAIPRKIYGNEDFEKFIEFINSKILTNELIVKVNEKDLKNVELPSTKIYKKQKNVFRSEDIIEHNLNIEKISFSPRIHRCGKPQHYIKLPKSLNEWKAIFYFAGVMFGDGCVDRIANNDEEVFNKLKSLNNLGIEVERIKRKSSYEIIFKNGKNALINLLKILFDYPSEKKSHNIKIPQILYIAPKELVAEFIKGYFDADGYVNLRQNRIEVISASKEFIEGLSILLLRFEITSKIYEIKKSYKETKKKYYQLNIVGKRNLKNFKNIGFSIKYKEENLNKIIEKSRKSEKYPINKDMKRLRILFGMTRNEVNVSYYAKYENGKEIPSYEIVKKFLNSLKPKNLDKKIKVLEGKERDVNYLKAFESDGLIENGRLTKLGREALNIWKNHEFGKENIDYMKSLIENIAFVEVEDVEIIDYDGYVYDLTTETHNFIANGIVVHNT

SEQ ID NO: 84 - protein, 550 aa, Artificial sequence
  synthetic
KCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNT

SEQ ID NO: 85 - protein, 455 aa, Artificial sequence
  synthetic
QSLGRDELIFIKEGDKLKVCKIGEAIDEFMEKYKDKIIVDGDTEILYLDGIAEVYTISVNVKTGKAEFKRVYAISRHKPRGKVYKVIGKDGTSIIVTEDHSLFNYDENGNLVCVKPRQMKHIIRNFNNPYDVEYRIGDYIETNYQRTDSKYNSRQNDIPEKLKITKELCQFLGLFVAEGSYITNGISITTKDDDIAKFIERFVKEQINENIAVKRYEDSVRFVNKGFYRFLKEHINGKAINKNSPEFILKGDKEMKLAFLGGLISGDGYVSKDGRVQIYTTSEQLLGQLHLLLSDLGMIYSITKIKEEGEKIEIKRNEIVRNYKLYVIEIAKNCTEDLKPYVIPKYKKERIKPANYDQLPYDYRIIKEHLRKITDKKPYNDYAWKSNNRKLKLNTLEKIEQLNPHLREEINKFKLNIPFEIKEIKEIDYNGYVYDLSVEDNENFITATGILCHNT

SEQ ID NO: 86 - protein, 535 aa, Artificial sequence
  synthetic
SSLPYDEKILIFENNEYKLVKIGEFVEKYLNRYKDRAITYGDNNIEVYIKDENIYAPSFDKDGKIVLKPITHAIRHRGKEIYEIELESGKKVRVTGDHSVFTINDNLDVVEVKASDLKVGDFIITPKIIPSISKDKIYLSEIVKNKDKYYVKIKDHIKFIEEHEEILKESYKEYKTKWKDLKPVLKKKNAFRLDLIEDLVDKEKIEKISYGHANYINNKIKLDEKFGYLIGAFLSEGHWNDKCVEISSTNKEFIENLVEIIEEILGKDAYYITVKGDKRRYKDLYVIGLNKTVAMIFESLGLNKLSSNKEIPSILLSNETFLKGLIKGYIDGDGSIYVDESKRDYSIRLYTTSETLRDTLCLALKILGINYRLSIDKKSKVNENWRDCYVIKITGKENIEKLLDVEIKNNGGKDVIPKIAEKFKEIINQYSQREWKERFGIDVNNLHIWEDLKKGYMSRYRAKKVLNIMKNVKEIEEKYGRLLDKIGQLIDNDLLFERIKSIRVLDEIPEYVYDISVEGTENFIGGEGFICLHNT

SEQ ID NO: 87 - protein, 473 aa, Artificial sequence
  synthetic
MSLPYEEKIIIKEGEFIKPVEIGKLVDEMIERFGFEKIGNSEVCDLPIDIYALSLDQDEKVHWKRIISCIRHKHNGKLIKIKTKSGREITATPYHSFVIRKDNKIIPVKGSELKIGDRIPVVKHIPANCVEAINISDYVSGNYVVDNINNKIAPKINGKSIPNNIKLDYDFGYFIGIYLAEGSVTKYFVSISNVDELILNKIRAFADKLGLNYGEYDNNNGFAESHDIRIYSSTLAEFLSNFGTSSNTKKIAEFVFGANKEFVRGLIRGYFDGDGNVNADRKVIRVTSNSKELIDGIAILLARFNIFSIKTKTKNQFVLIIPHRYAKKFHEEINFSVEKKKSELERLVSSLNDDKTYDSIDMIPSIGDALTKLGEKVDYPKVILKKFERKQKIGRATLQRHLRRIEELAVKKGVNILALKEYWLLKKAVESDVIWDEIVKIEEISCDKKYVYDISVEGLETFTTFDGVLTHNT

SEQ ID NO: 88 - protein, 524 aa, Artificial sequence
  synthetic
KCVAPETKICLADGRFVRADELFEELKERGRLVKCDESEEVYELREPVGVSSLDKDAVEIVEGKITHVWRLKADKLVEVEVKNGRSIRTTPEHKFLVLDPSGEIVEKRADELEIGDYIVCTQKLVHEGMSEEELKREVFRRLGRDFFVHLPEEEAESVLELAKERGIKALWETLEVDIEENSFYYQLRKGRIRADILVDLAEELGLDLADLYDAVEVSYRSNTKSTKPIRLPEPEDLFYLAGLMFGDGCWNQLTNGSEAIQGEVKRIASDMGLEVRVRRYEGKTARIDFPETVPRILEALFDYPRRKKAHRIRVNDFLTRAPLDCIAEFIRGYFDADGTVEEGRSAVSVTSVSREFLEDLQLLLQKFDVASYLREGDGAYTLYVSGARSLERFPGFREPEKAEKLKKLMEKASSSELEKVPISGEILREVRGDVPTTRMFNCYSNYEGGQVGLTKSSLEKVISTLEAVGVEGEALERLKALARDDVCFLEVVRVEEVEYDGYVYDFTVEEHHNFAAEGFVVHNT

SEQ ID NO: 89 - protein, 160 aa, Artificial sequence
  synthetic
DSVVKDAKVIIKEDGKIKEIKIEDLFKKVDYTIGDKEYCILNNVETLTIEDTKLVWRKVPYIMRHRTNKKIYRVKVKDRYVDITEDHSIIGVKNNKLVELKPTEIKDDETKLIILNKDLKSYNFASVEEINCIKYSDYVYDIEVENTHRFFANGILVHNT

SEQ ID NO: 90 - protein, 270 aa, Artificial sequence
  synthetic
LCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNT

SEQ ID NO: 91 - protein, 396 aa, Artificial sequence
  synthetic
KCLLPDEKVVVPSVGFVTLKELFETASKVVERDDEKEIRELDERITSVNGDGKTGLVKASYVWKVRHKGKVIRVKLKNWHGVTVTPEHPFLTTKGWKRADQLRPGDYVAVPRFIHGNEDEKIFLSYVKVKKSGEEWKEYFYLAGRKGNIDVNLLFVAPKRYVVEFLRGYFEERSEVKGESVIVEARELVEPLSLALLRFGIFSKIQGSKLIVTGKRNLEAFKDYIGFKDEREKALEEAIEKVKGSEVYPIFEEIRRLRLLFGFTREELGSYAKYENSEAPTYEELMEILDFIERGSPSLSKKIAILEGKLKAELRVLEEEGLIKDGKLTPLGRELLEVWRNREFDSKDVDYIRNIAETLVFIPVENVEEEEYDGYVYDLTTETHNFIANGILVHNT

SEQ ID NO: 92 - protein, 501 aa, Artificial sequence
  synthetic
KCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNT

SEQ ID NO: 93 - protein, 401 aa, Artificial sequence
  synthetic
GCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNT

SEQ ID NO: 94 - protein, 431 aa, Artificial sequence
  synthetic
KCVDGDTLVLTKEFGLIKIKDLYKILDGKGKKTVNGNEEWTELERPITLYGYKDGKIVEIKATHVYKGFSAGMIEIRTRTGRKIKVTPIHKLFTGRVTKNGLEIREVMAKDLKKGDRIIVAKKIDGGERVKLNIRVEQKRGKKIRIPDVLDEKLAEFLGYLIADGTLKPRTVAIYNNDESLLRRANELANELFNIEGKIVKGRTVKALLIHSKALVEFFSKLGVPRNKKARTWKVPKELLISEPEVVKAFIKAYIMCDGYYDENKGEIEIVTASEEAAYGFSYLLAKLGIYAIIREKIIGDKVYYRVVISGESNLEKLGIERVGRGYTSYDIVPVEVEELYNALGRPYAELKRAGIEIHNYLSGENMSYEMFRKFAKFVGMEEIAENHLTHVLFDEIVEIRYISEGQEVYDVTTETHNFIGGNMPTLLHNT

SEQ ID NO: 95 - protein, 369 aa, Artificial sequence
  synthetic
LCVAPDSLVVVNDKVQEIGKLTEEWGREVGFLEYSSGIFYAPYLGRGISLDLVTGKVKPSVVSKVWKLKSPEELVTIKTITGKEITVTPETKLLTFNGTLEWKEAGKIKPGDYVLTVKKLHINGKQETLDEKLAYKRGLSLSDPLEFFSSSERTISAYLKGIFDKVGRLVGDTAVIKVDKDMAKRLQILLLRLGIVSSVDETGKVIIGREYIQKILGYNVSVVTHEVELFREFIAEISKFYGTSEEDVYSSLHEKGELDIGTVPVELPEGLREEINRERATYSELVKIAQEIKDEKLYNKLAWILSEVTEEEAKIKEKVNTLKVILSSDLIPERVESVKIIKSPYPYVYDLTVEGSHSFIANGFVVHNT

SEQ ID NO: 96 - protein, 389 aa, Artificial sequence
  synthetic
KCLLPEEKVVLPEIGLVTLRELFELANEVVVKDEEKEVRKLGKMLTGVDERGNVKLLNALYVWRVAHKGEMIRVKVNGWYSVTVTPEHPFLTNRGWVKAGELKEGDYIAIPRRVYGNEDLMKFSKIAKELGIKGDEKEFYLAGASLDIPIKVLFLAPSKLVSAFLRGYFDAKGVVRENYIEVPLFEDLPLLLLRFGIVSRIEKSTLKISGKRNLELFRKHVGFTDSEKAKALDELISKAKESERYPILEELRRLGLLFGFTRNELRIEENPTYEVLMEILERIERGSPNLAEKIAVLEGRIKEENYLRILEEEGLIENGKLTELGKELLEVWRNREFDSKDVDYVRNIVENLVFLPVEKVERIEYEGYVYDVTTETHNFVANGILVHNT

SEQ ID NO: 97 - protein, 527 aa, Artificial sequence
  synthetic
KCLTGDTKVIANGQLFELGELVEKLSGGRFGPTPVKGLKVLGIDEDGKLREFEVQYVYKDRTDRLIKIKTQLGRELKVTPYHPLLVNRENGEIKWIKAEELKPGDKLAIPSFLPLITGENPLAEWLGYFMGSGYAYPSNSVITFTNEDPLIRQRFMELTEKLFPDAKIRERIHADGTPEVYVVSRKAWSLVNSISLTLIPREGWKGIRSFLRAYSDCNGRIESDAIVLSTDNNDMAQQIAYALASFGIIAKMDGEDVIISGSDNIERFLNEIGFSTQSKLKEAQKLIRKTNVRSDGLKINYELISYVKDRLRLNVNDKRNLSYRNAKELSWELMKEIYYRLEELERLKKVLSEPILIDWNEVAKKSDEVIEKAKIRAEKLLEYIKGERKPSFKEYIEIAKVLGINVERTIEAMKIFAKRYSSYAEIGRKLGTWNFNVKTILESDTVDNVEILEKIRKIELELIEEILSDGKLKEGIAYLIFLFQNELYWDEITEVKELRGDFIIYDLHVPGYHNFIAGNMPTVVHNT

SEQ ID NO: 98 - protein, 427 aa, Artificial sequence
  synthetic
KCVDGDTLILTKEFGLIKIKDLYEKLDGKGRKTVEGNEEWTELEEPITVYGYKNGKIVEIKATHVYKGASSGMIEIKTRTGRKIKVTPIHKLFTGRVTKDGLVLEEVMAMHIKPGDRIAVVKKIDGGEYVKLDTSSVTKIKVPEVLNEELAEFLGYVIGDGTLKPRTVAIYNNDESLLKRANFLAMKLFGVSGKIVQERTVKALLIHSKYLVDFLKKLGIPGNKKARTWKVPKELLLSPPSVVKAFINAYIACDGYYNKEKGEIEIVTASEEGAYGLTYLLAKLGIYATIRRKTINGREYYRVVISGKANLEKLGVKREARGYTSIDVVPVDVESIYEALGRPYSELKKEGIEIHNYLSGENMSYETFRKFAKVVGLEEIAENHLQHILFDEVVEVNYISEPQEVYDITTETHNFVGGNMPTLLHNT

SEQ ID NO: 99 - protein, 446 aa, Artificial sequence
  synthetic
KCLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHNT

SEQ ID NO: 100 - protein, 527 aa, Artificial sequence
  synthetic
KCLTGDTKVIANGQLFELRELVEKISGGKFGPTPVKGLKVIGIDEDGKLREFEVQYVYKDKTERLIRIRTRLGRELKVTPYHPLLVNRRNGEIKWVKAEELKPGDKLAVPRFLPIVTGEDPLAEWLGYFLGGGYADSKENLIMFTNEDPLLRQRFMELTEKLFSDARIREITHENGTSKVYVNSKKALKLVNSLGNAHIPKECWRGIRSFLRAYFDCNGGVKGNAIVLATASKEMSQEIAYALAGFGIISRIQEYRVIISGSDNVKKFLNEIGFINRNKLEKALKLVKKDDPGHDGLEINYELISYVKDRLRLSFFNDKRSWSYREAKEISWELMKEIYYRLDELEKLKESLSRGILIDWNEVAKRIEEVAEETGIRADELLEYIEGKRKLSFKDYIKIAKVLGIDVEHTIEAMRVFARKYSSYAEIGRRLGTWNSSVKTILESNAVNVEILERIRKIELELIEEILSDEKLKEGIAYLIFLSQNELYWDEITKVEELRGEFIIYDLHVPGYHNFIAGNMPTVVHNT

SEQ ID NO: 101 - protein, 378 aa, Artificial sequence
  synthetic
KCVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHNT

SEQ ID NO: 102 - protein, 417 aa, Artificial sequence
  synthetic
YCVTGDTLINTDRGLIKIKDIVPDSEENSDNPINIKVQSLNRKINHSDMFFNSGKHKTIKLETEEGYEIEGSFNHPVLTWTTENGKPVYKWKTLDSIRAGDYLVVSRENDIDSDQDLITEEEAVLLGSLVSEGYISENRAGFNNTDEEYASVFENAYKDIYGDTFCRYERTLKSGKTLVEYQIHHKEIIQDIREKEFDKKSSDKEIPFVVLQSSKRVQRAFLKALFEGDGTVYETARAVNISYSSKSKKLLKQLQVLLLNFGIVSRIHRDKQNYRLIISGYQNIKLFKEKVGFLGKKQEKLIKLVEKIYKKETANSKTDFIPFIADYIRDKYRGKGFNEWLSKHSLDRYHKIEKYWDTLSNILDEEDRSLLKELLYNRYYFAKVKTVEETGEKIVYSIRVKSDCHSFVGNGIVNHNT

SEQ ID NO: 103 - protein, 335 aa, Artificial sequence
  synthetic
KCVTGDTPVLLADGTVMSIEDIYNKSSGTVEYKNENETLIRLDEPLRLYSFYNGHVNESTSNYIYKGKSDSIIKIRTASGREVKVTPVHKLFRFVDDKIIETEARYLNTGDFIASIKRFNNKDENYLSGDESELLGLYASYGSIEDGILIDASIKDRFINLAMNIFKLKTIKIEYRNDRVLIKNDGLKDFIARMISSGIPSEVMRSRACAASFINGYLYGKLYHDDVIKLHDNEQNILKISYMLTGLGIIHSIRNNLIEIKAENMKILNSMENELIDNNETLLISNNANDDFDLYPDEIESIEILPGPFDVYDVTTPDFGSNFVGGYGAILLHNT

SEQ ID NO: 104 - protein, 482 aa, Artificial sequence
  synthetic
ASVSYDTPVLIRDPINKIHLVKIGEFIDKFYEEGEERTAKHVNGYYVLSHDGFQVVWKPIKYVLRHRTNEIYEIIYEGGGKLEATGSHSVFVLDPDTLDIVEKPVMLLNKGEYLVSFNGVKENKDHQTIDLIDLVSDYNDVYVDNIPSELKKHTGGRNPIPLKQYMILRKRVITKKNNSLIKLRRSKYTLPIRLVLDEKLAFLFGAYIANGCVKERRDKLICFTFGKSAKNIADKVMNIMYEKFNIKPFIDDRGTYIIYEYPHTLLAIIFEKLLGRKLEEKKMPEILWSSPKSVIRAFFEGLRAYSQRTLRRRYTSYTTANKNLAYQLLWLARFAGFYSVLKEEKEAGKNNGKTYYHVIVYLDQSYRKPNASERVPVKPILKLIKYTKPRTMPPELAYIKRREFISRKTALKALEWIRRDGSFTDFSREYLRKIESLINGDIIVLKIKDVRKKQYKGYVYDISVPITEAFFGGNIPILLHNT

SEQ ID NO: 105 - protein, 352 aa, Artificial sequence
  synthetic
QSYHKDFKIMLADGRKVRIGDLVDELIGKNREKVIKGKDTEILFVDDLFLLSYNMRSGEQVLVKADRVSRHKAPDQFIKLRFSNGAEIIVTPEHPVLIINNGKIKTVRADTVRKGTLTIGVLGHKIIKEVNEDDIINNIRRKIVLDKELPYIHAKNISEAVEMRDQLMSIDIPTFIVKHKNEIRLYPSGPCSLRRLLLMHGVEEVVFSDELLYEIMNCHLYPATWYELLYSMGLTKIAKELNVYDFEILAGIIKKVEKEVIMLSQVLGLRNETQTELLHLKSRRELLIRLKDKLDMLRKRLKDLEEALGKDAVIRMITDVEVIKNTDSDWVYDITIEPYHLFVSDGLILHNT

SEQ ID NO: 106 - protein, 346 aa, Artificial sequence
  synthetic
KCLGKGTNVLMYDGTLKKVEDVKVGDQLMGDDSTPRNVLSLARGREEMYWVRQNKGIDYRVNKSHILSLKRSRNENGHHHGDVLNIEVSEYITKSDKFKSNYKGYKVAVDFPEKVLEVEPYFLGLWLGDGRSSDVRIATEDDEVVEYLQAYAFRLDKKVHRYAADGKCTMYGITSIQKEGALKDVSDSLQGKLRVLGVIDNKHIPRSYLTGSTKQRLELLAGLIDSDGYYDDAYHVMEIVQKRKELAEQIKFLADSLGFRSSLVKKKASIKAIGYESEVYRVRIVGHLNIIPTKVVRKQVRALMSKREHMHTGIKVEYDKVDDYYGFVLDGNHLFLLEDMTVTHNT

SEQ ID NO: 107 - protein, 176 aa, Artificial sequence
  synthetic
KCVSGDTPVLLDAGERRIGDLFMEAIQDQKNAVEIGQNEEIVRLHDPLRIYSMVGSEIVESVSHAIYHGKSNAIVTVRTENGREVRVTPVHKLFVKIGNSVIERPASEVNEGDEIACASVSENGDSQTVTTTLVLTFDRVVSKEMHSGVFDVYDLMVPDYGYNFIGGNGLIVLHNT

SEQ ID NO: 108 - protein, 159 aa, Artificial sequence
  synthetic
DSVTGDTEIIVKRNGRIEFVPIEKLFERVDYRIGEKEYCILEDVEALTLDNRGKLIWKKVPYVMRHRAKKKVYRIWITNSWYIDVTEDHSLIVAEDGLKEARPMEIEGKSLIATKDDLSGVEYIKPHAIEEISYNGYVYDIEVEGTHRFFANGILVHNT

SEQ ID NO: 109 - protein, 424 aa, Artificial sequence
  synthetic
KCLTADTYVWTDRGLETVAEVFGRAGLPLSSTSRVTDVRDRDIRVVNEKGELEQVAALTHNGRQPVVRITVASGRQVTVTRNHPLRVMNDDGFIVWREAGQLREGDVLVSAAFGAVQAASGGGLSEDEAVLLGYLTAAGSLDPAGHVCFTTTDIETGAEFAALAEWLLDTTVTAVPGDGQVAYVLSDPAARHTLAERYGVDYAAAARIPQCVRTAGDKMQRAFLAALYTAAGWTDTSAAVGLRTASAPLAREVQYLLYGLGIPADLDRSHGNGQHPWAVTISPAAAPRFHTEVGFRTAQQSPQTGLHEPTPQVEAIPNLTGLIHALRDSIGDRAESTDDPFPAASGGAYDRDQVRRVIDWAKRRTDEAPATANAILGYLTQLTDARYTYEPITAVEDAGQQPTFDLMVPRTHSFLANGILSHNT

SEQ ID NO: 110 - protein, 391 aa, Artificial sequence
  synthetic
DSVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYNVGLSLGLDKEEIEEKILKPLKNTGIISNYYDKSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHNT

SEQ ID NO: 111 - protein, 337 aa, Artificial sequence
  synthetic
QSYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHNT

SEQ ID NO: 112 - protein, 548 aa, Artificial sequence
  synthetic
KCLLPDEKVILPEHGPITLKGLFDLAKETVVADNEKEIRKLGAKLTIVGEDGRLRVLESPYVWKVRHRGKMLRVKLKNWHSVSVTPEHPFLTTRGWVRADQLKPGDYVAVPRVIHGNESDERFVSFVYEKLKNDELIAKLRGEVLSKISSEFKGDRAYKVERNVFRWEDIERLNLWDEVERVAFTPRMHRSGKPLHYVKLPRSPEEWEAFFYFAGVMFGDGSQDKIANNDVEVYEELKKLSVLGVAVKRVERTTSYEIELTNGKNALLRLLRVLFEYPERQKAKSIRVPRILFIAPRKYVSRFLRGYFDADGHVSLKDARIEVTSASQEFLEDLSLLLLRFGIVSKIYRSDYTTLVISGRRNLDLFRRYIGFSVKNKAEALEKAIKKSRRSESYPIFEELKRLRLLFGFTRTELNSNVPFYGKYESEEAPSYETLMRILDAIEKGSINLDKKIAVLEGRIRDHNYIKAFEKDGLIKDGKLTELGRELLEVWRNREFDSSDVDYIRNLAENLVFIPVEDIEEFEYEGYVYDVTTETHNFVANGILVHNT

SEQ ID NO: 113 - protein, 484 aa, Artificial sequence
  synthetic
KCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNT

SEQ ID NO: 114 - protein, 542 aa, Artificial sequence
  synthetic
KCLTGDAKVIANGRLFELGELVEKVSKGRFGPTPVEGLKVLGIDEDGKLREFEVQYVYKDRAERLIKVRTRLGRELKVTPYHPLLVNRKNGEIMWVKAEELRPGDRLAVPRFLPAIAEEDPLAEWLGYFIGDGHADSKNKVITFTNTDPSLRQRFMELTERLFPDAKIRERIHKNRAPDVYVNSRRAWELVSSLGLAGRKADKVYIPEKGWEGIRSFLRAYFDCDCGVDKNAVVLATASREMAEQVTYALAGFGITSKIREKKVRGKTYYHVTISGSENLERFLSEIGFSHREKLERTLKLVKKPNPNLDSLNVNYELISYVRDRLKLNFSDDKRSWSHRKARKISWELMKEIYYRLDELERLKESLSRSILIDWNEMAERRKEIAEKTGIRADRLLEYIKGKRKPSLRNYIKIAKALGIDLEPTINAMRVFARKYSSYAEIGRKLGTWNSSVRIILESNTEKIKELEEIRKIELELIGEILSDEKLKEGVAYLIFLSQNELYWDEITEVKELKGDFVIYDLHVPGYHNFIAGNMPTVVHNT

SEQ ID NO: 115 - protein, 456 aa, Artificial sequence
  synthetic
GCIDGNAKIIFENDGEEHIMTMAEMYERYKDLGEFYDPEYNRWGINVEEVPVYVKSFDPSTKEITKGKVKVIWKYELGEDVPKYEIKTNKGTRVLTSPWHPFFVITQDLKIVEKRADELREGDMLVGGMPSDDDYEFLLDYWLAGFIAGDGSIDKYRSHVKGHEYVYDRLRIYDYTTETLGIINDHLEKTFGKRYSLQRDRNIHYIDIKAKGITSHYIELLRGITNGIPQPILKEGRNAVLSFITGLFDAEGHVNSKPGVELGMVNRKLIEDITYYLNSLGIKARMRKKPRKDGVDYVMHVEEYSSLLRFYELIGKNLQNSEKRIKLEELLSKHNGGSFGLTLSFEDFKAWSSKYGVEFKTNGSQTLAIIKNEKVSLGQWHRRGRVSKAVLVKMLRKLYDTTKSEDVKRMLHLIEGLEVVKEINVTNEPKTFYDLTVERYQNYLAGENGMVFVHNT

SEQ ID NO: 116 - protein, 392 aa, Artificial sequence
  synthetic
DSVSGESEIIIRQNGKIRFVKIKDLFSKVDYSIGEKEYCILEGVEALTLDDDGKLVWKPVPYVMRHRANKRMFRIWLTNSWYIDVTEDHSLIGYLNTSKTKTAKKIGERLKEVKPFELGKAVKSLICPNAPLKDENTKTSEIAVKFWELVGLIVGDGNWGGDSRWAEYYLGLSTGKDAEEIKQKLLEPLKTYGVISNYYPKNEKGDFNILAKSLVKFMKRHFKDEKGRRKIPEFMYELPVTYIEAFLRGLFSADGTVTIRKGVPEIRLTNIDADFLREVRKLLWIVGISNSIFAETTPNRYNGVSTGTYSKHLRIKNKWRFAERIGFLIERKQKRLLEHLKSARVKRNTIDFGFDLVHVKKVEEIPYEGYVYDIEVEETHRFFANNILVHNT

SEQ ID NO: 117 - protein, 541 aa, Artificial sequence
  synthetic
KCLTGDVKVIANGRLCELGELVEKVSNGRFGPTPVKGLKVLGIDEDGKLREFEVQYVYKDRAERLIRIRTRLGRELKVTPYHPLLVNRKNGEIKWVKAEELKPGDKLAVPRFLPAIAEEDPLAEWLGYFIGDGHADSRSNVITFTNADPSLRRRFMELTERLFPDAKIKERIHKNRAPDVYVNSRKAWELVSALGFAGRKADKVYIPEKGWEGIRSFLRAYFDCDAGVDKNAIVLATASREMAEQVTYGLAGFGIISKIREKKVRGKLYYHVTISGSENVERFLSEIGFSHREKLEKAKKLVKKFNPNLDSLKVNYELISYVRDRLKLNFSDDKRSWSHRKAREISWELMKEIYYRLDELERLKESLSRSILIDWNEVAERRKEIAEKTGIRVDRLLEYIKGKRKPSLRNYLKIAKALGIDLEPTIDAMRVFARKYSSYAEIGRKLGTWNSSVRIILESNTEKIEKLEEIRKIELELIGEILSDEKLKEGVAYLIFLSQNELYWDEITEVKELKGDFVIYDLHVPGYHNFAGNMPTVVHNT

SEQ ID NO: 118 - protein, 431 aa, Artificial sequence
  synthetic
KCVDGNTLVLTEEFGLVKIKELYEKLDGKGRKTVEGNEEWTELETPVTVYGYRNGRIVGIKATHIYKGISSGMIEIRTRTGRKIKVTPIHKLFTGRVTKDGLALEEVMAMHIKPGDRIAVVKKIDGGEYVKLTTSPDFRKSRKIKVPEVLDEDLAEFLGYLIADGTLKPRTVAIYNNDESLLKRANFLSTKLFGINGKIVQERTVKALLIHSKPLVDFFRKLGIPESKKARNWKVPRELLLSPPSVVKAFINAYIVCDGYYHERKGEIEITTASEEGAYGLSYLLAKLGIYATFRKKQIKGKEYYRIAISGKTNLEKLGIKRETRGYTNIDIVPVEVESIYNALGRPYSELKGEGIEIHNYLNGENMTYETFRKFAKLVGLEEVAENHLKHILFDEVVEVKYIPEPQEVYDITTETHNFVGGNMPTLLHNT

SEQ ID NO: 119 - protein, 392 aa, Artificial sequence
  synthetic
DSVTGDSEVIIRRNGRIEFIPIEKLFERVDYTVGEKEYHVLSSNVEALTLDDNGKLTWRKVPYVMRHKTEKKIYRVWLTNSWYLDVTEDHSLIGYLNTSRVRAGKPLKDRLCEVKPLELGKSVKSLITPRAPLSRGIKPNEIALKFWELVGLLVGDGNWGGTSNWAKYYVGLACGEDKEEIAEKVLDPLKRAGVISNYYDKSKKGDVSILSKGLAKLMVRYFKDEDGNKKIPEFMFNLPKEYLEAFLRGLFSADGTVSVKRGVPEVRLTTISDRLASDVRKLLWLVGISNSIFREQNPNRYNGKSSGTYSKHVRIKDKLQFAQRIRFIINRKQEKLIKNLKESQYKRTTFKYEFDITPVKKVEEVTYNGYVYDIEVEGTHRFFANGILVHNT

SEQ ID NO: 120 - protein, 159 aa, Artificial sequence
  synthetic
DSVTSDTEIIVKRNGRVEFVPIEKLFERVDYRLGEKEYCILESVEALTLDNRGRLVWKKVPYVMRHKAKKKVYRIWITNSWYIDVTEDHSLIVAEDGLKEAKPIEIEGKSLIATKDDLSGVEYIKPRTLEEIPYDGYVYDIEVEETHRFFANGILVHNT

SEQ ID NO: 121 - protein, 456 aa, Artificial sequence
  synthetic
GCIDGNAKILFENEGEEHLTTMAEMYERYKHLGEFYDKNYNRWGIDVSSVPIYVKSFDPETGEVVRGRVKAIWRYELGEKVTKYNIKTNKGTRILTSPWHPFFVLNPDFKVVEKRADELSEGDMLVGGMPEDDNHEFIFDYWLAGFIAGDGSFDKQRSHVKGHEYIYDRLRIYDYRVETFETINKYLEETFGKRYSLQRDRNIYYIDIKAREITSHYRKLLDGIDTGIPPEILRKGRAAVLSFITGLFDAEGHVNSKPGVELGMVNRKLIEDIAHYLSSLGIKARMREKPRKDGVDYIVHVEEYSSLLRFYELIGKNLQNEEKRKKLETLLEKHKGGTFGLSLNFEAFKRWASKHGVEFKTNGSQTLAIIKGEKISLGQWHTRGRVSKAVLVKMLRKLYDATGVEDVKRMLHLVEGLEVVKEITTTNEPKTFYDLTVENYQNYLAGENGMVFVHNT

SEQ ID NO: 122 - protein, 391 aa, Artificial sequence
  synthetic
DSVAGNTEVIIRRNGKVEFVPIEKLFQRVDYRIGEKEYCALEGVEALTLDNRGRLVWRKVPYIMRHKTNKKIYRVWFTNSWYLDVTEDHSLIGYLNTSKVKSEKPLKERLVEVKPRELGEKVKSLITLNRAIARSIKANPIAVRLWELIGLLVGDGNWGGHSKWAKYYVGLSCGLDKAEIEEKVLRPLKEAGIISNYYGKSKKGDVSILSKWLAGFMVKYFKDENGNKRIPSFMFNLPREYIEAFLRGLFSADGTVSLRRGIPEIRLTSVNRELSNEVRKLLWLVGVSNSMFTETTPNKYLGNESGTRSIHVRIKNKHRFAKRIGFLLDRKATKLSDNLREHTNKKMAYRYDFDLVYPKKIEEINYDRYVYDIEVEGTHRFFANGILVHNT

SEQ ID NO: 123 - protein, 391 aa, Artificial sequence
  synthetic
DSVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYYVGLSLGLDKEEIEEKILKPLKNTGIISNYYDRSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHNT

SEQ ID NO: 124 - protein, 440 aa, Artificial sequence
  synthetic
GCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYGVRVVTAKGLERYLERIGVPKGSRLEALHGIKPDVRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNT

SEQ ID NO: 125 - protein, 440 aa, Artificial sequence
  synthetic
GCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYRVRVVTAKGLERYLERIGVPKGSRLEALHGIKPDIRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNT

SEQ ID NO: 126 - protein, 318 aa, Artificial sequence
  synthetic
QCLSEDTEILTLDGWKRYNEVEIGDSIYTFNINNGEIETKLVTYVFRKEYSGIMYNLKNRSQSQLISPNHRVVRKVFNTEKYRLDRIEDLLSYSSPLIIPVAGENKNPDYPISDEELKIFSWILSEGSIEREGSHRVSIYQSKETHPENYEEIIQLLEDLNFEYSVKEQHSLGKCKHIRLKPKSSKAIHELIGAKVKKFPEYLYRLSKRQARLFLETYLKGDGWTEKFRKRITVTEEEAKDFITAIAVLAGYNFNVRKRKMGGISKKLQYIITLTETKADHIMKIEKIEYRGIIWSVNTENETVIARRNGQVFITGNT

SEQ ID NO: 127 - protein, 592 aa, Artificial sequence
  synthetic
ESLPGDEKILIKSGNEISVKQIGEIVDRVLKNAGKEGKIYLDGRSEIVFNEEYDVKAFSFNDDFTVSEVPITQFIRNEPADIYEVNTTYGKKVRVTAGHNFFCLKNRVVCCKPLSELEVGEAILMPRRIQRVAEATFLSGYKNFVQNLTLEEMTDLFILGDPLRDLVRENEKMIRGRDKNNETKNYRKCVEKCGLPLDILCRTNYMPSLAELKQLRIVSWHGFEDTPEIPLYYEFTPELGEWLGLLLSEGCYSEPNKISFSNNDDLLHARFAELSKGIFGINIMPRRENNSSIISKSVIPIKAIFSLHGTRSNKSVPDFMYDAPKGCIEGFIRGYHAGDGKKSEMKMTTISEGILRFLRYAFLILGVVPSVYVSNRSNPKWSTSYDVGINSITKFYDLAKGGIGNYNYECGELIITIINEIGGVTGGKESVQLWGYGNARRGKSVSRGTIERFINDAKMRIDNNAEYVIMKEYGKSPFTPKNISELLNVSTKAAYEYVKRLCGRGLCKKVEKSTKYEHSIDYNYSLTDKIFKKYEKVFKSLKILSKLINGDVAFCKIKEIKKVGREETYDIATDTSTQNFIAGDGFLFVHNT

SEQ ID NO: 128 - protein, 470 aa, Artificial sequence
  synthetic
QSLPPWEPIVVRRGDEVRVTSIGEFVDSFLEGEGGLDIGGLGYYTLSLDTRTLKPVWRRIRGVIKHRIRGRLLRVKASKGRSIDLTGSHSIYRISRGGGLEVVGSSDLRPGDSLVTPASVELPESAPSSINAARELWSRGVEGIFVVGLPGEAAGYRGVERSRGYDGGHAIPLETLVERYGDSVWSLVSGAKLAVSRGAAGDHPVPATIPLDTGFYLLLGFIVSAGSVDVEGGHVTVTLGPGREGYVGDVVEAVNSTAPGAGVRISSGARGMEVTIRSRVLSELLARVFGAGPGPNRDIPSIVFRAPKPMKRVFLKGLYAGGGVFDRSSGSLIYATDSRSLLNGLALLLLNVGAGGYRIDSGDSGRALALIVENAGRLDAIGEVLEHLGFHGGREAVQGVGALERATAGLAGQATVAVQRPATRGGPGVDVAGVTGLEHLEASTEFVYDLSVEGDENFFAGLGWILVHNS

SEQ ID NO: 129 - protein, 278 aa, Artificial sequence
  synthetic
ACLHGDSLIVTDHGLVPMREVVNHRQRLQVSDGERQQTVYDWNRFADYPTVTMRTRAGFTLTGSHNHRIMLADGTWRRLDELQIGDRVRIAGGTELWATEPALLRCRRPLPRVLVTAGAPAATTSSPHRRGYRRAAAVVVDEKLAAAIGRRCVTHADQQALDAIRRSPRPQVVAFLRAFCQGAGQSVASGLTLTCADADLATTVQLLLTNLGVLAHRTDTTVRIDNGDDLERAYTTLATPTGWTDEVVALEHGTADVYDISVTATHRYAAQGFINHNS

SEQ ID NO: 130 - protein, 335 aa, Artificial sequence
  synthetic
KQLALDTPIPTPDGWTTMGEIKAGDKVIDEKGRPCNVVAISEIDDTEQAYKINFRDGTSIVAGERHLWKVQVTNNGRREKLLTTGEMYQKQFKTKSKENRALFRIPIADAFILPENKLPIDPYLFGYWIGNGNAVKPEITVMRDDVDEVIKNIPYKLHNRYKQEGNSDILVYKELKSILVKNFREKRIPIEYLRASAQQRKRLLQGLIDSDGCVSTAKSQAIYVTILFELAKDVQDLLWSLGIKNTLKTAPSARYGIETGEICYLIKFTAFNDLEVSGLDRKLKRGRERNIKTRSHFHYIKSIEKTGKTKMRCIQVDSPSRLYLAGKSMIPTHNS

SEQ ID NO: 131 - protein, 341 aa, Artificial sequence
  synthetic
KQLALDTPIPTPDGWKRMGELKQGDVVFDENGSPCHVLALSEIDDTEQAYRLTFGDGSSIIAGARHLWKVQIINNGRKERLLQTQQMYEAFSAYRKRHKDAPFRSIYRIPVAGALKLPDAKLPVDPYLYGYWLGNGCATRPEITIRTCDVAGVLKRIPYEVSSLWKNVGDSVVVRIPVLKSVLLKSHHSKHIPSEYLRASENQRWELLQGLMDSDGCIGKLKAQSIYVSTEKQLALDVRELLWSLGIKNSMTESPSQRCGKPTGKTLYTIRFTSFADLPTSGLARKLCRRKETGSSPTRSNYHYIHSIEPVKERIPMRCIQVSSPSRQYLAGTSMVPTHNS

SEQ ID NO: 132 - protein, 197 aa, Artificial sequence
  synthetic
AAVDELDKMRCVTGDTLVQAGDGRRRIRELAGETAEAGSIEELPNGRTIRDVDIDVWTMTDDETLTRRPVTAIHEYDAPETLYEVTLSTGEEVTVTPDHPFFIEQASGRVETPAEDLQPGDLVFVPEGSAMATDGGIAQIDTSSDRLGPAESGLGDIGLRTIENVESVPDHDYDSVYDLTVEGTHNFLANGMVVHNS

SEQ ID NO: 133 - protein, 530 aa, Artificial sequence
  synthetic
KCLDADTNVQLADGTTSAIGELVEANLDDPKPVDDGVWDHASIPLPTLAPDGSLTTAEATKVWKREAPEHLYRIRTESGKELDVTPSHPLFVQQDGTPTAMEAENLEEGEFVATPRSVPTAGDDRIEADHRESQSPNAVRFSAPDTWTPSLARLVGYIVAEGHVVHRADNTADLRITNEDEPVLEDARAAFEALDLPYSEDVREESGVTRLRCHSSEFVSFLEAIEPAILENSAYQRVPERIKQASDSIRRAFLRAYVEGEGHVAASERELTVASMSEALLEDVRCLLTTLGIDASIHERVNGSYRLRISGDDFGHYVSAVGFVTDRKQLAAESYEGTAGNTNRDVVPVSGDTLREVREALALTQTDCGVPRTTYQHYERGDRNPSRGSLRAVVDAFEKRLAWLKDQREGLAAEDWETIVELRDELSISQQSLADGMDVTQTAISYYERNEVAPDGGETVAASSVINDRLEEALAVESTVDRLDDLATNDVRWDRIASIEAVEPDDEWVYDLEVEGTHSYVSNGVVSHNS

SEQ ID NO: 134 - protein, 433 aa, Artificial sequence
  synthetic
ASVSKDTPILVKINGEVKRTTFAELDKLYFNERDGDISYKDTPNLEVLTVDDNYNVRWAKVSKIIRHRVEKILRVHLEGGGVLELTGNHSIMLLGENGLVAKKASEIKVGDYFLSFVTEMPGLLDKISLNNYQLRRESARTKVFDELYINEDLAWAFGLYTAEEFREDTSGQVIYTLGSHELPLIERIKTIAQELDLSIYENFTSSGFDRSRFSAKQVRILNTQLAKFIKENFYDGSGERAVNKRVPSFMYEAPIQDRISYLKGLADGDIWDKVIRISSVSKDLLIDIAWLSRISGIESSIFDQEVRLIWKGGMKWKKSDLVPADIVISLLKKLENKINGNWRYELRHQLYDGKKRVSKDIIKKILKMIEVEELKEDERKILSLLRKLAYSDLHAVKVTKIEVIEYNDFVYDVSVPNNEMFFAGDIPILLHNS

SEQ ID NO: 135 - protein, 361 aa, Artificial sequence
  synthetic
RCHPKGTKVVVKGRGIVNIEEVKEGDCILGIDGWQRVKKVWEYDYEGELINVNGLKCTPNHKIPLKYDYLIRDIYAKSLLNKFKGEGKLIRCKDFELIGNYEKYINDIDEDFILKSELIGILLAEGHLLRKDIEYFDSSRGKKRISHQYRVEITVNEDEKDFIERIKYIFKKLFNYELYEKRRKNSKAITLGCAKKDIYLEIEEIMKNKEKYLPNAILRGFFEGDGYVNTVRKTIVVNQGTNNYEKIKFIASLLDKLGIRYSFYEYNYEERGKKLKRYIIEIFSRGDLIKYSVLVGFISKRKTDLLNEIIRQKTLYKLGDYGFYDLDDVCVSVEHYKGKVYDLTLEGRPYYFANGILTHNS

SEQ ID NO: 136 - protein, 479 aa, Artificial sequence
  synthetic
NSILPDEYLTVIEEDGVKIIKIGDYIDDLMRKHKDKIKYDGLSEILEVDNLKTYSFNRKTKKCSINRVKALIRHPYSGKAYKIKLRSGRTIKVTEDHSLFKFEKGRPVCVRGDEIQPGDLIVVPRKLKFVNKKDVIINIPKRLVDADEEELKDLTITKHKDKEFLVRLRKTLEDIKNNKLKIIFDDCISYLENLGLIDYSIIKKINKIDIKILDEEKFDAYKKYIDTFVEYGTFRKDRCNIQYIRIKDYIPNIPDKEFEDCEIGAYSGKINALLKLDEKLAKFLGYFVTRGRLKKLKIKGETVYEISVYKSLPEYQKEIAEVFKEAFGAGSIAKDKVTMDNKIIYLVLKYIFKCGNRDKKHIPEEIFLANENIIKSFLEGFLKAKKNSHKGTTTFMAKDEKYLHQLILLFSLVGIPTRFTPVKNKGYKLTLNPNYTIVEDLMLDEVKEVEAFDYTGYVYDLSVEKYENFLINNIYAHNS

SEQ ID NO: 137 - protein, 490 aa, Artificial sequence
  synthetic
NSILPNQWMPIVEDNDIKFVKIDNYINQLMDRNKYKIKFDGNSEILEVDNLKAFSFNRQSKKCEIKRVKALIRHKYSGKAYKIKLRSGREIEVTMGHSLFKYENGKIVEVKGEDVKVDDLIVVPKSIVAIEEDITINIPKVLAKLDDDSLILEIPKEKRNEIKKKISTIKDKSLRKFYELILKHSKYTKNGNYIIKLSKVKDIIDYIPDKEFINFKIGTRGGKRINAIIKLDEDVAKFLGYYVSEGYARCSKNQKNGYSYEIYIANHDKDILKDMERVTTKIFDKCKVCKDRVRVMSKIAYLFVNYVVPCGIKAENKQIPEIIFKAKKSIKLAFLEGYFIGDGDIHPSKRLRLSTKSEKLAYQLMFLLNSLGISAVKIGFDSGVYRVYINEDLPFITTNRKRNKYYSNVIPKEILEYIFNKKFQNNMSIDKFKEFIKDKDINGFEWLLNGDITFDRVKEIEEFDYNGYVYDLSVEDNENFLINNIYAHNS

SEQ ID NO: 138 - protein, 530 aa, Artificial sequence
  synthetic
VCVSPDTKILTNNGLIEIKDLKSNNKILGIDNFKGKFTEFDKPHIRDYNNDGFLIKTNLGFEIKCTKEHRFLTIANGELKWVESRTLKVGDYIAVLRKYPNDGEKINILDLLPDNAYVGLKKSTLEKIRMKIKEKYGTSKNFSKIIGMEKSHFNAKLRGESPFKLKVLREIEKILSIKIESEDIEIIRTNKKKYPMEIKTFTPFLARLLGFWMADGSWTSGCLRLFSSDLQLLKEYEKRIIEELNMKPHYRRANKSTYCLEISSSVLETMFKNLVGNKKRKSKNGMFPEILYKLPLEHKKAFLSGYFDGDGFLEIKKDNKLYSIGFSTFNKRFAEGIRDLLLYFGIMSSVRKQEINYENELNGRIIKKRGVSYTVSILGGEYLEKAINILDIWRTKDRELIKKAFSAGYCNIDIIPNIGKKLREIREKLRISTYKLQKEKFYNPQRVEVGERQISRRNLIKLMNKYLDYAKKTNNKEVIEEIESLLRLAEGDIFFDRIKEIKSIKLKKVYGIINSKTGNYIVNNFISKNS

SEQ ID NO: 139 - protein, 478 aa, Artificial sequence
  synthetic
NSILPDEYLVVIEDDKVKVTKIGEYVDNLIEKNKEKVKYEKKSEILEVDNLKTYAFSKIDKKCRIRKVKALIRHPYSGKAYKIKLRSGRSIKVTKGHGLFKYENGKIVAVKGDEIKIKDLIVVPRKIPYINKEVIINIPKGLIDADEEEINDLTITKHKDKEFLVKLKKTIEDIEKNKLNVVFEDCLKYLEDLGLIRYEGIKRINKLEIDIPNKRKLSIYKKYIETILDYGTFRKGKCNIQYIKVKEYIPDIPDKEFEDCEIGAYSGKIKALLRLNENLAKFLGYFVARGRLKEIKLKGETVYEACVYKSLPEYQEEIAEVFKKAFGAGAIARDKVTLDKKIVYLVLKYIFKCGYKGRKHIPEQLFLANEEVIKSFLDGFLKAKKNSHKGTSTFMAKDEEYLNQLMLLFNLVGIPTRFTPVKNKGYKLTLNPNYELVKDLMLDEVKEIEEFDYNGYVYDLSVEEDENFLVNNIYAHNS

SEQ ID NO: 140 - protein, 501 aa, Artificial sequence
  synthetic
HCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNS

SEQ ID NO: 141 - protein, 503 aa, Artificial sequence
  synthetic
LCLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHNS

SEQ ID NO: 142 - protein, 371 aa, Artificial sequence
  synthetic
RCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNS

SEQ ID NO: 143 - protein, 478 aa, Artificial sequence
  synthetic
NSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNS

SEQ ID NO: 144 - protein, 438 aa, Artificial sequence
  synthetic
ASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNS

SEQ ID NO: 145 - protein, 396 aa, Artificial sequence
  synthetic
ESIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNS

SEQ ID NO: 146 - protein, 307 aa, Artificial sequence
  synthetic
ASVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHNS

SEQ ID NO: 147 - protein, 367 aa, Artificial sequence
  synthetic
GCFDYSTRAQLADGTTEKIGKIVDNKMDVEVLSYDPDTDRIVPRKVVNWFNNGPAEQLLQFTVEKSGGNGRARFAATPNHLIRTPGGWTEAGDLIAGDRVLAAEPHRLSDQQFQIVLGSLMGDGTLSPDPRGRNGVRFRMGHGADRVDYLEWKTALLGNIKHSTGENAEGARFVDFTPLPELAELRRAVYLGDDGRKFISEEYLKALTPLALAIWYMDDGSLTVRSEGLQQGTAGGSGRIEICVEAMTEGSRIRLRDHLRDTHGLDVRLRQAGAGGKAVLVFSTAATAEFQELVAPYMAPSMEYKLLPRFRGQSRVVPQFVEPTQRLVPARILDVHVEPHTRSMNRYDIEVEGNHNYFVDGVMVHNS

SEQ ID NO: 148 - protein, 276 aa, Artificial sequence
  synthetic
LCLNAKTEILQENGYRKITELNKNEKIFALCGGKIKPIGRWKIHKTPQHDYNITIKTENGLEITTTPNHIFLVKNGKSIKEKEAKDLKIGDLVATVGKIIVDEDINTSNFVKFPIRRLSQFIAETFNSKGVINNSIEIYSTSELFIKRLQVALLRFGIHSQIEIKNSDKKDDKTYLLKISDLEGLKLFYKNFPIDLKEKEKLFYLIKKKINNKPYEDNLEHIDFDNSFNNIAICWKKILEIKKVKVEDEYVYDIELPNDGSNDHYFVANGFVVHNS

SEQ ID NO: 149 - protein, 241 aa, Artificial sequence
  synthetic
RCHPRGTKVIVKNNGLTDIENVKVGDYVLGIDGWQKVKRVWKYPYNGFLVNVNGLKSTPNHKIPVIKKENGKDRVIDVSSIYLLNLKGCKILKIKNFESIGMFGKIFKKDTKIKKVKGLLEKIAYIDPREGLVIKVKNEKEDIFKTVIPILKELNILYKQVDEKTIIIDSIDGLLKYIVTIGFNDKNEEKIKEIIKEKSFLEFKELEDIKISIEEYEGYVYDLTLEGRPYYFANGILTHNS

SEQ ID NO: 150 - protein, 475 aa, Artificial sequence
  synthetic
NSILPDEYLTVIEDDGVKIVKIGEYINRLMEKYPNKIKLSEVLEVKNLKTFSFNKLTKKCEIKKVKGLIRHKYEGKAYKIKLRSGRTIRVTEGHSLFKYENGEIVEVKGNEIKINDLIVVPRKIAHINKKIVINIPKRLVDADEEDIKNLVITKHKDKIHFIKLKKTLEDIERNKFNVIFDDCILYLKKLGLIDYNIIKAINKVEIKILDKKKFKIYKKYIDTIIEHGNFARGRSNIQYLKIKDLINDIPDEEFEDCEIGALCGKINALLKLDENLAKFLGYFVTRGGLNKYKAKEGTTHEVAIFKSLPDYQKEIVKIFKKTFGAGCISKDKVIMDNKIVYLILKYIFKCGNKNKKHIPEEIFLADEKVIKSFLDGFLKAKKNSHKGTTTFMAKDEDYLNQLMILFNLVGIPTRFTPVKNKGYKLTLNPNYKLINDLMLDEVKEIEEFNYNGYVYDLSVEDNENFLVNNIYAHNS

SEQ ID NO: 151 - protein, 644 aa, Artificial sequence
  synthetic
RCVTGDTLVHTGDGIKPIRELAHEAVPSGSIEELKNGRTIRDVDVDVLTMTEDGSIVKRDVSAIHEYDAPDELHEITLESGEQLTTTADHPFFVLNEGNREERQAQDLNENDWIFVPDTIPATVADGGVSVLPSADAETETNRLSPSHGAILGYIAGDGNIFYDRDEGCYGFRFTNNEEELLSDFEETCTNAFSTQAVRHPSEQRADGVETVRVHGKQYVDELLDSGANLENYDGKRLPEAVTSASRETKSAFIRALADSEGTVDKRAVKLFSSSYELLLGTKMLLLEFGISSQIQTRPRDGGRDLFILAITSRESLEAFKRSIGFTLKRKHRALERACERTTGDRTILDVLPECGELFEQARGALRLYQSECGLENDSTYCNFENGDANASLRLSRPILEAFEDRKLAAKEHYSELISEASWERLAELREQYHISQQELAAEMSISQQQLSAQWGGDFELQEQVRYRLRDLLETPASVDLDPLRGLIESDVKWRRVETIRRIDSREHTDARVRVLEQRLADEIGAETVDSVRESARSLIETENSAETWDELRIRLETYGISFQQVAAEMDVAGSTVSRWFSGTVDVDNFEAVRSVCEELLNAKRRRISELLQEIDRRDQPRVYDLTVEGTHNFVANGMVVHNS

SEQ ID NO: 152 - protein, 414 aa, Artificial sequence
  synthetic
NCFTPDTEVLTPDGVRDITDLEVGDEVYSLDPETEALEVKPVVETHAYPEYDGDLVDIETNKIDFRVTPNHRMLVRKNETNGITEDEYSFIEAGDLDRATNYELPHDWDGPDGNELDTVDLTELIDGEYEVWVRPSVHGHTFTTELGWKPRRVPKADVGKTGYVFTAEEFEAHREYIEEVCETSFIHRDSGRKWIPRTYDGDKFLDLLAWFVTEGNVYTSEDKQFGENFRGSATTVKLAQDKLPIADGGLGHHATIGELLDEMGFDYYVDDRSYTVTSKLLGNFLTSCCGDGSFEKRIPELVFECSHRQKRRFLEVLIDGDGDRQTNSWRYTTSSNRLRDDVLRLCAHLGLTANYSRDSGTWRIYVTEGSKNTLRMHRSSTQSTADNGVYCVTVEDNHTLLAGRNGKFQFVGQS

SEQ ID NO: 153 - protein, 335 aa, Artificial sequence
  synthetic
QCFSGEETVVIRENGEVKVLRLKDFVEKALEKPSGEGLDGDVKVVYHDFRNENVEVLTKDGFTKLLYANKRIGKQKLRRVVNLEKDYWFALTPDHKVYTTDGLKEAGEITEKDELISVPITVFDCEDEDLKKIGLLPLTSDDERLRKIATLMGILFNGGSIDEGLGVLTLKSERSVIEKFVITLKELFGKFEYEIIKEENTILKTRDPRIIKFLVGLGAPIEGKDLKMPWWVKLKPSLFLAFLEGFRAHIVEQLVDDPNKNLPFFQELSWYLGLFGIKADIKVEEVGDKHKIIFDAGRLDVDKQFIETWEDVEVTYNLTTEKGNLLANGLFVKNS

SEQ ID NO: 154 - protein, 440 aa, Artificial sequence
  synthetic
ACFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNS

SEQ ID NO: 155 - protein, 403 aa, Artificial sequence
  synthetic
QCFSGEEVILIEKDGEKKVFKLREFVDGLLKEASGEGMDGSIRVVYKDLQGENIKILTKDGLVKLLYVNRREGKQKLRKIVNLEKDYWLALTPEHKVYTIKGLKEAGEITKDDEIIRVPLTILDGFDVAEKSIREELERLSLLPLNSEDSRLEKIAGIMGALFGSGGIDENLNTLSFVSSEKKTIEQFVKALSELFGEFDYKIEEKENSIIFRTCDKRIVTFFATLGAPVGDKSKVKLKLPWWVKLKPSLFLAFMDGLYSSNRNDKEILEITQLTDNVETFFEEISWYLSFFGIKAEAEEDEEKDKYRARLTLSSSIDNMLNFIEFIPISFSPAKREKFFKEIEKYLEYSIPEKTEDLKKRVKRVKKGERRNFLESWEEVEVTYNVTTETGNLLANGLFVKNS

SEQ ID NO: 156 - protein, 477 aa, Artificial sequence
  synthetic
VCVSGDSKVLTEKGPVEIRHLNSGMIVGINGFKSRFVKFQELHQVKYQEYGVKIRTQLGFEVKCTREHRFLTIDKNGELRWVEAWRLKEGDYVGIIRKLPSPNSKVLILDFLPESTYLWLNKEFLKKLKVSIKEKFGSIKNYAKERGFNSSYLVKQLNGLSPFRWGRLRVILNDVSIEISRDDIERITSRRGKYSLPPELTPGIARLLGFWMASGSLNRNTLIFYSQDKKILERYEDLCKREFRVKGRIKAQDKGTYILEIPSSLLSFVFKNLARPKLEVPPIIYILPEKHKEEFLAGYFDGNGFIKIENGRIHSLGFFAFNRKFAEGIRDILLQLGILSSINEQTFEVSIIEGEKFLKIVNSWRSNYYKEWEDVIPNLEKRLKEIEEKLGYPGTYNRREIRRSELKAIIKLYEKVARERGLNDVLKELSYLKELSEGDIFFDRITSIEPVYLDVAYGIINSETGNYVVNGFVSKNS

SEQ ID NO: 157 - protein, 476 aa, Artificial sequence
  synthetic
QCFSGEEVIIVEKGKDRKVVKLREFVEDALKEPSGEGMDGDIKVTYKDLRGEDVRILTKDGFVKLLYVNKREGKQKLRKIVNLDKDYWLAVTPDHKVFTSEGLKEAGEITEKDEIIRVPLVILDGPKIASTYGEDGKFDDYIRWKKYYEKTGNGYKRAAKELNIKESTLRWWTQGAKPNSLKMIEELEKLNLLPLTSEDSRLEKVAIILGALFSDGNIDRNFNTLSFISSERKAIERFVETLKELFGEFNYEIRDNHESLGKSILFRTWDRRIIRFFVALGAPVGNKTKVKLELPWWIKLKPSLFLAFMDGLYSGDGSVPRFARYEEGIKFNGTFEIAQLTDDVEKKLPFFEEIAWYLSFFGIKAKVRVDKTGDKYKVRLIFSQSIDNVLNFLEFIPISLSPAKREKFLREVESYLAAVPESSLAGRIEELREHFNRIKKGERRSFIETWEVVNVTYNVTTETGNLLANGLFVKNS

SEQ ID NO: 158 - protein, 462 aa, Artificial sequence
  synthetic
NSILPDEWLPIVENEKVRFVKIGDFIDREIEENAERVKRDGETEILEVKDLKALSFNRETKKSELKKVKALIRHRYSGKVYSIKLKSGRRIKITSGHSLFSVKNGKLVKVRGDELKPGDLVVVPGRLKLPESKQVLNLVELLLKLPEEETSNIVMMIPVKGRKNFFKGMLKTLYWIFGEGERPRTAGRYLKHLERLGYVKLKRRGCEVLDWESLKRYRKLYETLIKNLKYNGNSRAYMVEFNSLRDVVSLMPIEELKEWIIGEPRGPKIGTFIDVDDSFAKLLGYYISSGDVEKDRVKFHSKDQNVLEDIAKLAEKLFGKVRRGRGYIEVSGKISHAIFRVLAEGKRIPEFIFTSPMDIKVAFLKGLNGNAEELTFSTKSELLVNQLILLLNSIGVSDIKIEHEKGVYRVYINKKESSNGDIVLDSVESIEVEKYEGYVYDLSVEDNENFLVGFGLLYAHNS

SEQ ID NO: 159 - protein, 430 aa, Artificial sequence
  synthetic
GCLAGDTLITLADGRRVPIRELVSQQNFSVWALNPQTYRLERARVSRAFCTGIKPVYRLTTRLGRSIRATANHRFLTPQGWKRVDELQPGDYLALPRRIPTASTPTLTEAELALLGHLIGDGCTLPHHVIQYTSRDADLATLVAHLATKVFGSKVTPQIRKELRWYQVYLRAARPLAPGKRNPISDWLRDLGIFGLRSYEKKVPALLFCQTSEAIATFLRHLWATDGCIQMRRGKKPYPAVYYATSSYQLARDVQSLLLRLGINARLKTVAQGEKGRVQYHVKVSGREDLLRFVEKIGAVGARQRAALASVYDYLSVRTGNPNRDIIPVALWYELVREAMYQRGISHRQLHANLGMAYGGMTLFRQNLSRARALRLAEAAACPELRQLAQSDVYWDPIVSIEPDGVEEVFDLTVPGPHNFVANDIIAHNS

SEQ ID NO: 160 - protein, 425 aa, Artificial sequence
  synthetic
RCVAEGTLIVDARTGRRVPVEEVQPGMEVWSLGPDLRLHRVPVQARFDNGIQTVYKVRTRTGRTIELTAEHPLLTLQGWKHLCDLKVGDAIAVPISLATEGDLSPDPARVKLLAYLLGDGNTVHRTPRGDAPTARFFTSSPALRNDFLNAVQTLGGQVRIYKHPITGVETIYCTAPKGQADPVLTLIREVGLIGRAHEKRVPEEVFRYTQAALRLFLGRLWSTDGSIEKKRLSYCSTSMELIEDIAHLLLRLGINTIRRQRTTTHRPAFELVITDQRDIVLFARQIGPYLVGDKKKRLKALVRQALQRVRNQSIYLIPAEVGHLVRAAKVKSGLSWTHAGARVGVPGTSLSAGLNLKTPRRALSRHRTALLGRAFADETLLALSEGEVLWDPIVEITPVGRKRVYDLAVPPFANFVAQDIVVHNS

SEQ ID NO: 161 - protein, 362 aa, Artificial sequence
  synthetic
RCHPADTKVIVKGKGIVNISDVKEGDYILGIDGWQRVKKVWKYHYEGKLININGLKCTPNHKVPVVTENDRQTRIRDSLAKSFLSGKVKGKIITTKLFEKIAEFEKNKPSEEEILKGELSGIILAEGTLLRKDIEYFDSSRGKKRISHQYRVEITIGENEKELLERILYIFDKLFGIRPSVKKKGDTNALKITTAKKAVYLQIEELLKNIESLYAPAVLRGFFERDATVNKIRSTIVVTQGTNNKWKIDIVAKLLDSLGIPYSRYEYKYIENGKELTKHILEITGRDGLILFQTLVGFISSEKNEALEKAIEVREMNRLKNNSFYNLSTFEVSSEYYKGEVYDLTLEGNPYYFANGILTHNS

SEQ ID NO: 162 - protein, 540 aa, Artificial sequence
  synthetic
  misc_feature (265)..(265): Xaa can be any naturally occurring amino acid
  misc_feature (270)..(270): Xaa can be any naturally occurring amino acid
NSILPNEWLPIIENGEVKFVKIGEFIDRYMEEQKDKVRTVDNTEVLEVDNIFAFSLNKESKKSEIKKVKALIRHKYKGEAYEVELNSGRKIHITRGHSLFTIRNGKIKEIWGEEVKVGDLIIVPKKVKLNEKEAVINIPELISKLPDEDTADVVMTTPVKGRKNFFKGMLRTLKWIFGEESKRIRTFNRYLFHLEELGFVKLLPRGYEVTDWEGLKRYRQLYEKLVKNLRYNGNKREYLVRFNDIKDSVSCFPRKELEEWKIGTXKGFRXKCILKVDEDFGKFLGYYVSEGYAGAQKNKTGGMSYSVKLYNENPNVLKDMKNIAEKFFGKVRVGKNCVDIPKKMAYLLAKSLCGVTAENKRIPSIIFDSSEPVRWAFLRAYFVGDGDIHPSKRLRLSTKSELLANQLVFLLNSLGVSSIKIGFDSGVYRVYINEDLPFLQTSRQKNTYYPNLIPKEVLEEIFGRKFQKNITFEKFKELADSGKLDKRKVKLLDFLLNGDIVLDRVKNVEKREYEGYVYDLSVEDNENFLVGFGLLYAHNS

SEQ ID NO: 163 - protein, 427 aa, Artificial sequence
  synthetic
KCLPARAKVVDWRTGRVVSLGEIVRGEAQGVWVVSLDEDRLRLVPRPVVAAFSSGRAQVYALRTATGRVLEATANHPLFTPQGWRPLGALAPGDYVALPRHLPYRPSAHLEDHELDLLGFALSEGNLRHPSGFYLYTSSEEELAAMEEALKRFPNTRTRVAWRRGVAHLYVGRQDRRREAGAVAFLREQGLLGLSAREKRLPEVAYRLPPEEVARFLGRLWTGDGGVDPRGRLIHYATASRALAEGVQHLLLRLGLQSRLVEKRFAYKEGRTGYAVYLLGGLEAAHRFAQVIGPHLIGKRRRDLEALLASWEAAGRSTKDILPLAFLDTVKAALAEASRGQVAALLKEAGLAQGLLRPGRGRLGLSRATLERLAALTGNLALLRLAQAEVYWDRVEAIEPLGEEEVFDLTVEGTHTFIAEDVIVHNS

SEQ ID NO: 164 - protein, 366 aa, Artificial sequence
  synthetic
GCMSYGTRVTLADGTQEKIGKIVDQKMDVEVLSYDPQLDKIVPKRVVNWFDNGNAERFLQFTVAKSGGNGRAQFAATENHLVRTPGGYREAGELIAGDRVMVMETHRLSDQQWQVVLGSVMGDGSLSPNRRGRTGVRFRMGHGAGQAAYLDWKVSLLGNIPCTRSVNAKGAVFADFTPLPELDELRRVVYFGDGKKHLTWDYLKALTPLALAIWYMDDGHLAVPSKELQDRTAGGSGRVEICVEAFSPGSRERLVEYLRDTHGLDVRLIERGARKAGVLQFTTAASAKFQELIAPYVHESMDYKLLPRLRGRCTVEPQFVDPEPRLVPAQILDVRVKPKTRSMRRFDIEVEGAHNYFVDGVMVHNS

SEQ ID NO: 165 - protein, 359 aa, Artificial sequence
  synthetic
GCMHYDTLVTLADGTQEKIGTIVDRKLDVEVLSYDPETDRIVPRRVVNWFDNGAADHFLQFTVGRSGKPGGAQFTATPNHLIRTPGGWREAGELIAGDRVLVHEPHYLNEQQRQVVYGSLMGRGTLVPDRHGGPGVHFCMAHTAEQAAYLDWKVSLLGNIAHSRTAEASATVGVEFTPMPELSELHRVVDFGDGHTHLTWEFLKQLTPLALAVWYLDAGTLTIPQSGTDDDARVQIDVETLSPGSRQRLVEYLRDTHELDAAVVQQGADARSLLEFTPAATVRFLELVAPYVPESMSSMLLAQFRGRCSVTPEYSDPVQRLVAAPVLDIQVKPGSTRKFDIEVEGNHNYFVDGVMVHNS

SEQ ID NO: 166 - protein, 343 aa, Artificial sequence
  synthetic
YCVDEETEILTTDGWKTFRETAPGDLALTLNHSTGLAEWQPILDVYVFPAQPRTMIRMEGRTHSSLTTPQHRWPVERATRTTAASEETRRERTWATTETLTDGDRIPQAAPCRDLPTEPKWSDALVELVAWLWLGDHATRSRHSATLALSQRDGLGAARIRAALHSLFGPPAPQPSRGGRRPWWRERLTRSCVEFHLSPGASRMLLEHIPDGAVSFGFLRSLTRAQLNLFIDTSVRACRAHGTTTASRTALVHRDRRRAEAFQFAAILAGYPASLRHRTLPGPAPADVWLVHLDTAQDFAPKAATPGLTIAEEPYTGRVWCVRTPNATWLARRAGTVYFTGNS

SEQ ID NO: 167 - protein, 539 aa, Artificial sequence
  synthetic
NSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRSVSYEKFRELVKSEKLDGEKAKRIEWLLNGDVVLDKVLEVKKRPYEGYVYDLSVEEDENFLAGFGLLYAHNS

SEQ ID NO: 168 - protein, 405 aa, Artificial sequence
  synthetic
LCMHPDTYVVTKSGAKKVSELTEGDEVLTHTGTFKKVIQPLRREHKGRLLVIKAYGTVPVKITPEHMVWVVKQIRHKSHYSDGRQVIWWEFEGPEWMTAQELKERLESETDPKVSYMLLQPIPEPSVDADKIPLRKEVYVVNQHGKTDKLHPSVKRTPEYLPLNFETARLIGLWIAEGSTSKNGVIKFDISSNEEDLTEFITGTIRKYFPHAKIVVKDHERNRRTVRFCNKRFAEWLRENIGHGADNKSIPPLLLLNKNREVRLGLLRGLIEGDGYVRRESQRRANYISYSTVSPSLAYQLQLLVASLGYTSSIHRSIRTEGIGKTRKPIYDVKVSGKSYYSLLEELGFEVPQRGNRTYNVNRTWKNYLLLKVRSIEEEEYEGDVYNLEVEGDESGSVGFIVHNS

SEQ ID NO: 169 - protein, 527 aa, Artificial sequence
  synthetic
VCVSGDSKILTGKGPVEIGRLNSNMIAGIWRFQTELVRFEEPHRVEYRREGVKIRTRLGFEIKATKEHKFLTVDENGELRWVEAWKLKEGNWVGVVRRLPSPNVKVSILDLLPPNAYLKLKGEFLRELKLSIQAKFGSIRTYAKKKRWSESYLVKQLNGVYPFRWERLSAVLKDLDLRMTENDVERITSDKGKYSLPIEFTPSMARLLGFWMADGSWKGGTLTLFSSDRKMLEKYKELCKEEFGVVGRIRMLNESTYSLEISFNLLPAIFKNLTGNTERKSKLGTFPSIIYSLPEEHKREFLAGYFDGDGFLEVKGGRVYSAGFSTFNKRFAEGIRDILLQLGIVSSIRAREYDEVQKFKGRVIPKKGASYTVSVLGGEYLKRFFDAVRPWRSDYEGWEGMYNEGYSNSDVVPNLGKRLRSIRERLGISAYRMSKMGFYNPVRVELGEREISRRNLRLLVEFYERVAKEKRVEDVLEELSYLRELAEGDVFFDRITSVEPAYIDVAYGIINSETENYIVEGFISKNS

SEQ ID NO: 170 - protein, 362 aa, Artificial sequence
  synthetic
RCHPADTKVVVKGKGIINISEVQEGDYVLGIDGWQRVRKVWEYDYKGELVNINGLKCTPNHKLPVVTKNERQTRIRDSLAKSFLTKKVKGKIITTPLFYEIGRATSENIPEEEVLKGELAGILLAEGTLLRKDVEYFDSSRKKRRISHQYRVEITIGKDEEEFRDRITYIFERLFGITPSISEKKGTNAVTLKVAKKNVYLKVKEIMDNIESLHAPSVLRGFFEGDGSVNRVRRSIVATQGTKNEWKIKLVSKLLSQLGIPHQTYTYQYQENGKDRSRYILEITGKDGLILFQTLIGFISERKNALLNKAISQREMNNLENNGFYRLSEFNVSTEYYEGKVYDLTLEGTPYYFANGILTHNS

SEQ ID NO: 171 - protein, 476 aa, Artificial sequence
  synthetic
QCFSGEESIVIEKGKEKRVFKLREFVDSALKEPSGEGMDGKIRVVYKDLQGEDVKILTKDGFVKLLYVNRREGKQKLRKIVNLEKDYWLALTSEHKVYTARGLKEAGEITKDDEIIRIPITVLDKFDVARTYNEEEKLKAYLRWKEYHEKTGNGYKKAAKELGIKESTLRWWTQGAKPNSLKMIEELEKLNLLPLNSEDSRLEKIARILGALFSDGSIDKNLNTLSFVSSEKEAIELFVKTLGELFGDFDYEIKENRESRGRSILFRTWDRKIIRFFVALGAPAGNKTKVKFELPWWIKLKPSIFLAFMDGFYSGDGSVPRFARYKDGIKFNGSLEIAQLTDELEKKLPFFEEIAWYLSFFGIKAKVRVDEARGKYKVRLILSQSVDNVLNFLEFIPISFSPAKKEKFLREVEKYLAEVPESSLAERFGELKERFEKIKRGQRRHFIESWEEVEVTYNVTTETGNLLANGLFVKNS

SEQ ID NO: 172 - protein, 187 aa, Artificial sequence
  synthetic
KCVEYNTEVVLSDGSIKPIGELVDEAIEKAKERGTLGVVDDGYYAPIDLEIYALDASTLKVRRVKANIAWKRTAPERMFRIKTASGREIKVTPTHPFFVFDEGTFKTRKAEELKVGDKIATLRRENEPIEIPETKNEHLKKLLASSDIFWDRIEEIEEYKPEHPWVYDLQVPEHHNFIANDIFVHNS

SEQ ID NO: 173 - protein, 540 aa, Artificial sequence
  synthetic
NSILPNEWLPIIENGEIKFVKIGEFINSYMEKQKENVKTVENTEVLEVNNLFAFSFNKKIKESEVKKVKALIRHKYKGKAYEIQLSSGRKINITAGHSLFTVRNGEIKEVSGDGIKEGDLIVAPKKIKLNEKGVSINIPELISDLSEEETADIVMTISAKGRKNFFKGMLRTLRWMFGEENRRIRTFNRYLFHLEKLGLIKLLPRGYEVTDWERLKKYKQLYEKLAGSVKYNGNKREYLVMFNEIKDFISYFPQKELEEWKIGTLNGFRTNCILKVDEDFGKLLGYYVSEGYAGAQKNKTGGISYSVKLYNEDPNVLESMKNVAEKFFGKVRVDRNCVSISKKMAYLVMKCLCGALAENKRIPSVILTSPEPVRWSFLEAYFTGDGDIHPSKRFRLSTKSELLANQLVFLLNSLGISSVKIGFDSGVYRVYINEDLQFPQTSREKNTYYSNLIPKEILRDVFGKEFQKNMTFKKFKELVDSGKLNREKAKLLEFFINGDIVLDRVKSVKEKDYEGYVYDLSVEDNENFLVGFGLLYAHNS

SEQ ID NO: 174 - protein, 438 aa, Artificial sequence
  synthetic
ASVSKDTPILVRLNGKVMRTTFAELDKIYFDENDGEVAYKDAMNLEVLTVDENYKVRWARVSKIIRHRVPVILKIHLEGGGTLELTGNHSVMVLTENGLESVKASELKEGSYLLSFVSSVPGFLDVLNMEDYTVKPSARVRTFGEIPLNDELAYMMGLYAAEGAVSFKGVTSGQVIYTLGSHEGELIERVREFAEGLGVSVYENYTTSGFDRSRRSAYQIRLLSTQLARFFEDNFYDGHGRRSENKRVPGFIFEASLEERIAFLKGLADVDGSGEWESVVRVSSVSKDMLIDTVWLARISGIEASLFEREARLIWKGGMKWAKAELLPAEPIIKMLLRIEDAVEGNWRYNFRHQLYEGKKRVGKGILRDVLDMVNVEKLDDEGREIYETLRKLAYTDLHALAIRKIELIEYNDFVYDVSVPGNETFFAGEIPVLLHNS

SEQ ID NO: 175 - protein, 525 aa, Artificial sequence
  synthetic
VCVPGHSKIFTAEGTRRIDRLGEKTAIVGVEETRSRFVGFDGTHKIEYNTKGVKIRTRLGFEVEATLGHKFLTVKDGRLTWVEAGELKPGDYVGVLRRLPSPEKEVPIFEVLPGSAYLHLRAEFLRELKRNIQAKFGSIKAFAKRWNMGESHLSKQLRGEYPFSWERLKLILSEVDMTIEEDDVERITSDKNSYKLSKKFTPGMARLLGFWLADGSWKGGTVTLFSGDLEMLKRYAELAKQEFGIDGHIRRQNESTYALELSFNVLLHLFSGLVGKNKKSKFGVFPEILYRLPMKHKIQFLSGYFDGDGYLEVKGGRIYSAGFVTFNPEFAEGIRNLLLQLGIVSSLRSQDYDEEQFFRGRTVPKKGTSYTVAVLGGDYLRTFGELIEPWRPNLRKIKGLSTGYSNRDVIPNLGKKLREIRETLGISSYRLQKMGIYNPMKVELGTREISRRNLVRLLDFYEMVAKEREMSDVLAEIQRLKELAEGDVFFDRIESIEPVFIKEAYGILNSETGNYVVNGFVSKNS

SEQ ID NO: 176 - protein, 537 aa, Artificial sequence
  synthetic
NSILPDEWVPLLIDGRLKLTRIGDFVDNAMDEGNPLKSNETEVLEVLGINAISFNRKTKISEVRPVRALIRHRYRGKVYSIKLSSGRKIKVTEGHSLFTVKNGELVEVTGGKVKPGDFIAVPRRINLPERHERINLADVLLNLPEEETADVVLTIPTKGRKNFFRGMLRTLRWIFEGEKRPRTARRYLEHLQKLGYVRLKKIGYEVLDEKALRKYRALYEVLAEKVRYNGNKREYLVAFNDLRDKIEFMPEEELREWKIGTLNGFRMEPFIEVNEDLAKLLGYYVSEGYAGKQRNQKNGWSYSVKLYNNDQKVLDDMERLASKFFGKVRRGKNYVEMPKKMAYVLFKSLCGTLAENKRVPEVIFTSPENVRWAFLEGYFIGDGDLHPSKRVRLSTKSETLVNGLIILLNSLGISAVKIRFESGVYRVLVNEELSFLGNSKKKNAYYSHVIPKEILEDVFEKRFQKNVSPKKLREKIKRGELNQEKAKRISWLLEGDIVLDRVEEVEVEDYNGYVYDLSVEENENFLAGFGMIYAHNS

SEQ ID NO: 177 - protein, 476 aa, Artificial sequence
  synthetic
QCFSGKESIIIEKDGERRVVTLKEFVDSALKEPSGEGVDGEINVIYKDFRNDKVKILTKDGFVKLLYANRREGKQNLRRIVNLEKDYWLTVTPEHKVYTAEGLKEMDELTKDDEIIRVPVIILDRFDVARTYNEEKKLKDYFRWKDYYEKTGNGYKRVAKELGIKESTLRWWTQGAKPKSLKMAEELEKLGLLPLKNEDERLEEIAKVMGILFSDGNIDKNLNTLSFVSSEREAIEKFVRILGNLFGEFEYEIKENREAMGESILFRTWDRRVIRFFVALGAPVGNKTMVKLELPWWIKLKPSLFLAFIDGLYSGDGSVPRFAHYRDGIKFNGTLEIAQLTDELEKKLPFFEEIAWHLGLFGIEAKVRVDKADGKYKVRLIFSQSIDNVLNFLEFIQISLSPSKRERFLGEVEKYINAVPDSSLAEKLKEFKERFERIKKEERRNFIESSEEVEVTYNVTTETGNLLANGLFVKNS

SEQ ID NO: 178 - protein, 540 aa, Artificial sequence
  synthetic
NSILPNEWLPIIENEEIKFVKIGEFIDRYMEEQKDRVRTVDNTEVLEVDNLFALSLNRESKESEVKKVRALIRHKYRGKVYAIGLNSGRKITVTGGHSLFTIRKGEIREVSGAEIKAGDLIVVPKKVKLNEKEVTINIPELILRLPDEATADIVMTIPVKGRKNFFKGMLRTLRWIFGEESKRIRTFNRYLFHLEKLGFVKLLPRGYEVTDWEGLKIYKQLYEKLVESLRYNGNKREYLVMFNDIKDVISSFPQKELEEWKIGTLNGFRMDCILKIDENFGKLLGYYVSEGYAGAQKNKTDGISYSVKLYNENPNILGDMKNAAERFFGKVRVGKNCVSISKKMAYLLMKCLCGVTAENKRIPPIIFNSPEPIRWAFLEAYFAGDGDVHPSKRLRLSTKSELLANQLIFFLNSLGVSSVKIGFDSGVYRVYINEDLQFLRTSREKNTYYSNLIPKEILEEIFGRKFQRNITFEKFKEFVDSGKLDKRKAKLLDFVLNGDIVLDRVKNVKKREYEGYVYDLSVEGNENFLVGFGLLYAHNS

SEQ ID NO: 179 - protein, 438 aa, Artificial sequence
  synthetic
ASVSKDTPILVRINGRVMRTTFAELDKLYFNESDGEVAYKDASNLEVLTVDENYCVKWAQVSKIIRHHVPVILHVHLEGGGKLELTGNHSVMVLTENGLETVKASELKEGTILLSFTTNIEGFLDVLDMSDYSIKESARTRTFKGLSVDEELSYIFGLYAAEGAVGFNGNTSGQVIYTLGSHEGQLIERIKAFVENLGVSVYENYTSSGFDRSRKSAYQFRLLNTQLARFFEESFYDGNGRRANNKRLPGFVFEFPIRERIAFLKGLADGDGTGEWGGVIRVSSVSRDLLIDTVWLARVSGIEASLFEREARLIWKGGMKWSKAELLPAEPIVKMLEAIENAIEGNWRYEFRHQLYEGKKRVRKATLRKAIEMVNEEKLDEKGKRILEVLKKLANTDLHALLVRKIELVEYNDFVYDVSVPGNEMFFAGEIPVLLHNS

SEQ ID NO: 180 - protein, 528 aa, Artificial sequence
  synthetic
VCVPGHSKIITSRGIRRIDGLSVDEEIVGVKESRSRFVEFGGTHRIEYNSTGVKLKTRLGFEVEATREHKFLTIKDGKLTWVEVEKLKPGDYVGVLRRLPSPDEEVPIFEILPDSAYLHLRTEFLRELKKNIQTKFCSINAFARKLGMSGSYLSKQLLGEYPFRWSKLKVVLQEVGMTLDESDVVRITSDKNSYELPKRFTPGLARLLGFWIADGSWKDGTVTLFSSDLDMLKHYAKLAKEELGIEGSIRKQNENTYSLELSFNVLFHMFREFVGNGGKKSLNGRFPEILYRLPKEHKAQFLSGYFDGDGYLEIKEGKRVYSAGFATFNPEFAEGIRNLLLQLGIVASIRRRHYNERQFFRGREIRKTGTSYTVAILGGEYLRKFAELVEPWRPGLRKIKEIPVEGYSNHDVIPGIGKRLRKLRETLGITSYMLQKAGFYNPVKVELGTREISRRNLVKLLNFYERVAGEGKVEGVIPEIEELRKLAEGDVFFDRIESVESVFIADAYGILNSKTGNYVVNGFVSKNS

SEQ ID NO: 181 - protein, 476 aa, Artificial sequence
  synthetic
QCFSGNESVVIRENGKIKAVKLKNFVENALKNPSGEGTDGDVRVVYHDFRNENVEVLTREGFTKLLYANKRVGKQRLRRIVNLEKDYWLALTPDHRVYTPSGLKEVGELTERDELISVPVVVLDEFGIAGTYGEEDKLRDYFRWMEHRERTGHGYKRASKELGIKASTLRWWEKGAKPKSLKMAEKLKGLDLLPLRSDDERLEKVALLVGALFSDGNIDRNLNTLSFISSEKEAVERFVDTLRELFGEFDYEIKENREAKGRSVLFRTWDRRVIRFFVALGAPVGNKTRVRLELPWWVKLKPSLFLAFFDGFYSGDGSVPRFARYKEGIKFNGTLEVAQLAEELEDKLPFFEELAWHLGLFGIDAKVRVDEARGKHKVRLILSQSIDNVLTFLELVPISLSPAKREKFIAEVEKYLNEAGDSRHADRLDELRKWFERVKKSEKRTFVETWEEVEVTYNLTTERGNLVANGLFVKNS

SEQ ID NO: 182 - protein, 537 aa, Artificial sequence
  synthetic
NSILPDEWLPLLVNGRLKLVRIGDFVDNTMKKGQPLENDGTEVLEVSGIEAISFNRKTKIAEIKPVKALIRHRYRGKVYDIKLSSGRNIKVTEGHSLFAFRDGELVEVTGGEIKPGDFIAVPRRVNLPERHERINLIEILLGLPPEETSDIVLTIPVKGRKNFFKGMLRTLRWIFEEEQRPRTARRYLEHLQKLGYVKLMKRAYEIVNKEALRNYRKLYEVLAERVKYNGNKREYLVHFNDLRNEIKFMPDEELEEWKVGTLNGFRMEPFIEVGEDFAKLLGYYVSEGYARKQRNQKNGWSYSVKIYNNDQRVLDDMEKLASKFFGRVRRGKNYVEISRKMAYVLFESLCGTLAENKRVPEVIFTSPESVRWAFFEGYFIGDGDLHPSKRVRLSTKSEELVNGLVVLLNSLGISAIKIRFDSGVYRVLVNEELPFLGNRKRKNAYYSHVIPKEILEETFGKQFQKNMSPAKLNEKVEKGELDAGKARRIAWLLEGDIVLDRVEKVTVEDYEGYVYDLSVEENENFLAGFGMLYAHNS

SEQ ID NO: 183 - protein, 539 aa, Artificial sequence
  synthetic
NSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRNVSYEKFRELVKSEKLDGEKAKRIEWLLNGDVVLDKVLEVKKRPYEGYVYDLSVEEDENFLAGFGLLYAHNS

SEQ ID NO: 184 - protein, 425 aa, Artificial sequence
  synthetic
KCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTGDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNS

SEQ ID NO: 185 - protein, 425 aa, Artificial sequence
  synthetic
RCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVPPAVAYRISEAKRRSGLSWSEAGRRVAVAGSCLSSGLNLKRPRRYLFRHRLFLLGEAFADPGLEALAEGQVLWDPIVAVEPAGKARTFDLRVPPFANFVSEDLVVHNS

SEQ ID NO: 186 - protein, 425 aa, Artificial sequence
  synthetic
KCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTRDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNS

SEQ ID NO: 187 - protein, 539 aa, Artificial sequence
  synthetic
NSLLPEEWVPVIVGDEVKPVRIGEFVDALMKTDSELVRRDGDTEVLEVKEIRALSFNRKSKKARTMPVKAVIRHRYAGDVYEIVLSSGRRIRVTTGHSLFAYRNGELVEITGGEVKPGDLLAVPKRVSLPERKERLDIVELLLKLPESETEDIVMTIPVKGRKNFFSGMLRTLRWIFGEEKRLRTARRYLEHLERLGYVKLRKIGYEVIDGGGLESYRKLYEKLAQTVRYNGNRREYLVDFNAIRDVIPLMPVEELKEWLIGTRNGFRMRPFIDVNEDFAKLLGYYVSEGNARKWKNHTGGWSYSVKLYNEDESVLDDMERLASKFFGRTRRGKNYVEIPRKMAYIIFEGLCGVLAENKRVPEVVFTSPENVRWAFLGGYFIGDGDVHPGKRVRLSTKSELLVNGLVLLLNSLGISAIKIRHDSGVHRVYVNEELPFTEYRKKKNVYYSHVIPKEVLEETFRKVFQKNMSREKFRELVESGKLDEERAKRIEWLLDGDIALDKVVEVKREHYDGYVYDLSVEEDENFLAGFGLLYAHNS

SEQ ID NO: 188 - protein, 379 aa, Artificial sequence
  synthetic
ECYSSDTQVLTYSGWKYFFELTEHDFIFTMNTETKKIELQKPVKFYEFDYNGAMYHFKSKKLDLLVTPNHRMLVQQYSPTSKENGKLKFIEAEKFNPNTHFIPKHALWEGRIEEYFILPEIKIYQYINFKKVNSKSESPDILEEEARIYSSQPIEKYEIKVLPPKKIPMNLWLKFFGFWLAEGCTYLRKRQRKGREVPYYEYLVRISQKKSEIAEEFEKVLSQIPFSYNKKFKADLIEFYINDKQLFSYLRKFGKSCDKFIPSEIKNLSKEQLEIIFDWLMKGDGWSGDGNIEYSTKSKRLADDIQEIVLKLGMSANIYERKKGNFKWYDVGVSLAKNFRLNSVNKQVTNYAGKVYCVEVPNHTLYVRRNGKACWCGNS

SEQ ID NO: 189 - protein, 534 aa, Artificial sequence
  synthetic
NSILPDEWIPLLINGRLKLVRIGDFVDSAMKELKPMKRDETEVLEVSGIGAISFNRKTKRSETMPVRALLRHRYSGKVYGIKLSSGRKIKVTAGHSLFTFRDGELVEIKGEEIKPGDFIAVPGRINLPERQERINLVEVLLGLPEEETADIVLTIPVKGRRNFFKGMLRTLRWIFGEEKRPGTARRYLEHLQTLGYVRLGKIGYEIVNEEALRDYRGLYETLTGKVKYNGNKREYLVHFNDLRDIIRLMPEKELKEWKVGTLNGFRMETSIEVKEDFAKLLSYYVSEGYAGKQRSQKNGWNYSVKLYNNDQNVLDDMETLASKFFGKVRRGKNYVEIPRKMAYVLFESLCGTLAENKRVPEIIFTSPESVRWAFLEGCFIGDGDLHPGKGVRLSTKSEELVNGLVILLNSLGVSALRIWLDSGVYRVLVNEELPFLDKGKKKTPYVTSKEIPEEAFGKRFQRNISLEKLREKVEKGEPDAEKVKRVVWLLEGDIVLDRVEEVAVDDYEGYVYDLSVEENENFLAGFGMLYAHNS

SEQ ID NO: 190 - protein, 169 aa, Artificial sequence
  synthetic
QSYHPLTEILLADGRKIRIGDLFDQTYAKADEIIEGIDCEIVPCEGVSVLSTDMNHITEQRVDRVSRHKAPDHFIKIRYSNDREIIVTPEHPVFIVKDGISCIPASAVTIGDPVPAPVEEQTGSKICSLYVTAVEVIPNEGQYRTDYVYDVTVEPYHCFVSQGVILHNS

SEQ ID NO: 191 - protein, 348 aa, Artificial sequence
  synthetic
LCFIEGTEVLTKRGFVDFRELREDDLVAQYDIETGEISWTKPYAYVERDYEGSMYRLKHPKSNWEVVATEGHEFIVRNLKTGKERKEPIEKVKLHPYSAIPVAGRYTGEVEEYDLWELVSGKGITLKTRSAVKNKLTPIEKLLIVLQADGTIDSKRNGKFTGFQQLKFFFSKYRKINEFEKILNECAPYGIKWKKYERQDGIAYTVYYPNDLPIKPTKFFDEWVRLDEITEEWIREFVEELVKWDGHIPKDRNKKKVYYYSTKEKRNKDFVQALCALGGMRTVVSRERNPKAKNPVYRIWIYLEDDYINTQTMVKEEFYYKGKVYCVSVPKGNIVVRYKDSVCIAGNC

SEQ ID NO: 192 - protein, 155 aa, Artificial sequence
  synthetic
ACQPYSAPVSTPDGPIPIGKLVDANAVGEKVFDASGVTRIVATTCNGRKPVLRIRTSGGHVLDVTPDHLVWQVVDQTAGRFVPAGQLRVGDRLEWHDRANSDAMVAAFTADSAAAAQPGQIVDILAIDELGVMPVYDIQTESGEYLSDGIRVHNC

SEQ ID NO: 193 - protein, 347 aa, Artificial sequence
  synthetic
PCVTGDTLVFTDKGLIEARKLEVGMKVWSGDGWNEIKEVINNGVKPVLKLKLKTGLEIKVTEEHKIFTGEGWKEAKDLKVGDKLYLPVSYPELDFPVKEENDFYEFLGYFLGDGSLSVSNHVSLHVGNDKELALYFKEKVEKYAGAAYLIERDGQYIIDVHRKEFAEKIKKIFGIEITDSKEKDIPSSLLAVNSEAMKALLRGLFSADGSVYDANGSITVALSSTSYPLLRKVQILLLSLGIPSTLTGEKDQDVKIIKGNEYETLPTYRLIISGERASLFFNKIGLIGEKKKKFLELMAGKTTYSTLNNHLYQEIVSIEPAGEEEVFDITAPPKYTWITNGILSLDC

SEQ ID NO: 194 - protein, 377 aa, Artificial sequence
  synthetic
PCVTGDTWVTTGAGPRQVRELVGRPFEAIVNGKAYGTGKDGFFQTGTKPVVKLCTREGYTVRLTADHMILRVTDKTRYRLSQEWVPAADLKAGDQIVLHNHRPLPGWPGALTEGEGYLLGLLVGDGTLKKETAILSTWVKKQAVNGSGAGDGVDSVMQLVLQYTGKMRHRADFTGWDPVKGRNEYRFKSAGIKVLAERMGLGPGRKTATPEIEGASSEGYRGFLRGLFDADGTIIGEQQKGVSIRLTQSNRDLLGIVQRMLARLGIISTIYEGRRPAGLKSLPDGNGGNKEYHIKAQHELVISRDNISVFAERIGFGNSEKAGRLKSLLEAYKRDLNRERFTATVLCVEEDGIEDVYDVQVPGINAFDANGIVAHNC

SEQ ID NO: 195 - protein, 483 aa, Artificial sequence
  synthetic
HCLLGKEKILVKNSKISNVYSLEELFKLESKENKVYKIGDLEVLKTNDLFVNSLNDSNLSSSWMPVSYLFKRKYKGDLVKIITEDNRKLIVTEKHPMLRLDNGSVEVVEARDLKVGDLLPLFKENFEEKIEIREVVVDLIKELSEEWENRVRVKIINGSWVNYKAEIYSICKTDRKYDYIKGDYLPLGIFRRLEREKKINIEHDSLILLTGRGPSTAKFPAVVKIDKDLARFIGYYLSEGCATKERGYYRIRLTINKDEKELFSDIESILNKLGLTHSIYLSPKFKAKTIRINSPLLGWLLIDRLRCGKDSYSMRIPDELMSASLDLKEELLKGLFRGDGDIHYRNERRNYIKNGKKYNHRNNSLVIGYFSISDVLFYQIIYLLQEMGIYPSISKNKNHLKISGYDNLKKLTDWFLDEKGRKYSNYFRFSLKKINNKRNNFPIPLVSVKKIEFESVDNIDVYSLEVENTHTFAVGSGIYVHNC

SEQ ID NO: 196 - protein, 363 aa, Artificial sequence
  synthetic
TCIEGDAKILTDRGFITMREAYELVKNGEKIRVLGLNAKTLRTEWKEIIDAQKREAKRFEVGVYRKNKNTKDTIKITPDHKFPIIKDGSLKKVPLAEIIENNYSVLSIDYIPMISEKFETLSNIMYLCGAILSDGHVEYQTSKIMPSKILGFVEDNINTIPLYATEEELTDFLAGYVDGDGYLSGKARIEIYENSKHVKKIEGLILSLYRVGIVPKMRIKNNTAVIYFKDNLEKILSKTKRITIEKLNQLKAEVREDNKLIDISQMFPECKEYDYRGYLYNHYKNRAFIGVEKLYNYLKERADGSLIKKIELIRNSNIYSIRLIKVGEDYGEVYNLTVDADNEFDHNYIVWTKYYTPIVVFNC

SEQ ID NO: 197 - protein, 394 aa, Artificial sequence
  synthetic
HCVPPDTLLILENGFKRIVDIKVGDKVLTHENRFKKVEKVYKRRYIGDIIKIKVRYFPEEIILTPEHPVYAIKTEKRCDGSHGICKFNCLTQYTNPSCKKRYRKYKREWIIAKDLKVGDVIVYPIPNRVRDIKYLSLDKYLSNIKREFCRSRIPEKIEVSEEFCRLVGYFLSEGYCFRDGIGFALGENEKKIIDDIEYLMKKIFNLKPKIRDDGRSEGIELKYYSRVLRDFFGDMFYCGDEKRAWNKALPNEFLYLPKNKQLQIFIGWWRGDKGVTTSEILMNQLRLISLRLGFIITFSKHVPKNPKIGDREVIKYHARWQGRVSILDEKIVDELKNEDIKLPKKDVRYGWIKGNYLYAPIIRIGREYYDGFVYNLEVEDDSSYVTVSGTLHNC

SEQ ID NO: 198 - protein, 414 aa, Artificial sequence
  synthetic
TCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNC

SEQ ID NO: 199 - protein, 545 aa, Artificial sequence
  synthetic
SCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNC

SEQ ID NO: 200 - protein, 496 aa, Artificial sequence
  synthetic
LCLTPDTYVVLGDGRIETIEDIVNAKERNVLSLDLDNLSIKIDTAIKFWKLRYNGNLSKITLSNNYELKATPDHCLLVLRDNQLKWIPAKDIKENDYIAMPFNYKVERKPISLLNLLKYLDITDVLIEFDENSTIFEKIAEYIRNNIKTSTKYKYLRNRRVPLKYLIEWNFDLDEIEKEAKYIYKSVAGTKKIPLFKLDERFWYFAGLVLGDGSIQDSKIRIAQTPLKDVKSILDETFPFLHNWISGNQVIISNPIIAEILEKLGMRNGKLNGIIFSLPESYINALIAGYFDTDGCFSLLYDKKAKKHNLRMVLTSKRRDVLEKIGIYLNSIGILNTLHKSREVYSLIISNKSLETFKEKIAKYLKIRKEAFINGYKTYKKEHEERFECDLLPVKEVFKKLTFEKGRKEILKDSKIHIENWYKEKTNNIPREKLKTVLRYANNSEHKEFLEKIVNGDISFVRVKKVENIPYDGYVYDLSIKHNQNFISNGVISHNC

SEQ ID NO: 201 - protein, 454 aa, Artificial sequence
  synthetic
VCVDGDTTVLLDGKLIKIKDLEDKWKDVKVLTSDDLNPKLTSLSKYWKLNADEYGKKIYKIKTELGREIIATEDHPFYTTNGRKRCGELKVGDEVIIYPNDFPMFEDDNRVIVDEEKIKKVINNIGGTYKNKIINELKDRKLIPLTYNDQKASILARIVGHVMGDGSLIINNKNSRVVFRGDIEDLKTIKEDLKELGYDGEEIKLHEGETEITDYNGKKRIIKGKGYSFEVRKKSLCILLKALGCVGGDKTKKMYGIPNWIKTAPKYIKKEFLSAYFGSELTTPKIRNHGTSFKELSFKIAKIEEIFDEDRFIKDIKEMLKEFGIELKVRVEEGNLRKDGYKTKVYVASIYNHKEFFGRIGYTYANKKETLARYAYEYLLTKEKYLKDRNIKKLENNTKFITFDKFIKEKCLKNGFVKEKIVSIEETKVDYVYDITTISETHNFIANGFLTGNC

SEQ ID NO: 202 - protein, 490 aa, Artificial sequence
  synthetic
NCLTSNSKILTDDGYYIKLEKLKEKLDLHIKIYNTEEGEKSSNILFVSERYADEKIIRIKTESGRVLEGSKDHPVLTLNGYVPMGMLKEGDDVIVYPYEGVEYEEPSDEIILDEDDFAEYDKQIIKYLKDRGLLPLRMDNKNIGIIARLLGFAFGDGSIVKENGDRERLYVAFYGKRETLIKIREDLEKLGIKASRIYSRKREVEIRNAYGDEYTSLCEDNSIKITSKAFALFMHKLGMPIGKKTEQIYKIPEWIKKAPKWVKRNFLAGLFGADGSRAVFKNYTPLPINLTMSKSEELKENILEFLNEIKLLLAEFDIESMIYEIKSLDGRVSYRLAIVGEESIKNFLGRINYEYSGEKKVIGLLAYEYLRRKDIAKEIRKKCIKRAKELYKKGVTVSEMLKMDEFRNEFISKRLIERAVYENLDEDDVRISTKFPKFEEFIEKYGVIGGFVIDKIKEIEEISYDSKLYDVGIVSKEHNFIANSIVVHNC

SEQ ID NO: 203 - protein, 456 aa, Artificial sequence
  synthetic
SCFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHNC

SEQ ID NO: 204 - protein, 484 aa, Artificial sequence
  synthetic
NCLAPGTKILTEHGCWVKVEDLPKMLTDQKLKVYDVDEGREDDSEIKFVMERGIEEDERAVVLVTESGLTIEGSEDHPVLTPEGYVELGEIEEGDLVVVYPFEGVEYEEKEGTILDESDFEDVDPQVLRYLEERDLIPLRWSDPKVGTLARILGFAMGDGHLGEQAGRLTLSFYGDERTLRELKRDLESLGVKANLHVRKRRYEIETASGRYEGEATSVELRVASRSFALLMEKLGMPRGRKVETPYKVPDWIKEAPLWVKRNFLAGLFAADGSVVKFKRYTPLPINLTQAKVEELEENLREFMNDVAKLLREFGIETTLYEVKSKKNVVYKLAIVGEENIKRFLGKVGYEYDPEKKVEGLAAYAYLKLKERVKKDRKEAAETAAEVYEETGSITKAHEAVADVVNRRFVERVVYDGGISSVRVPEDFPTFERFKEERVLAGGFVIEEVVEVKGVEPEYDRFYDIGVCHGAHNFIADGVVVHNC

SEQ ID NO: 205 - protein, 519 aa, Artificial sequence
  synthetic
YCFAPGTRVITASGDVVEIDEIVERAAETAVDGGLREGSTEVTVGVTNVRTLAAWDGDLTSNDVVAVEKIEAPSRAVRVRTRSGAELVVSEDHKFLVDTEDGPRMVEASELKSGDELYSVRELRVSEKVPTYLELLLEAEDKFYVHPTEEFEEAVAERYGSLAEACREKELPYRAREAKERRYYELSEFARLATAVIESVDEATEYIDYVTAGGRKRVKFSSPRPGKEVMYVAGLIASDGSVDTERGFVMFSNTERELLSAFEEIVTEEFGVDASKTENQNGVTMLRVNSRVLARVFERLADPKTVLKMPRELVAAYLAGYVDGDGHLKDGKIVITTADRERAGDLQLLLKRLGVPSVLRERDGAYDVVVTGHDAAELAEELPLRHPKKAEAAASMSSGRRSSRFDRVSRRFGRLLREVRRKYGVRASDLGSSSTISQIESGERRATRRLALEIVERLEEVVGDVEEVRELRELAEGNYVLDEVVEVETVEYEHEYLYDVTVVPDHTLVVENGIITSNC

SEQ ID NO: 206 - protein, 456 aa, Artificial sequence
  synthetic
SCFHPDEVLFIDRGRGLECITFKELFELEDKDDIKVLSFDGEKLSLKKLKLASKRYYNDDLITLRFNLGREIKITKDHPVVILEDRNLKVKLAEDVKEGDKVILPYGNFGEEQEIEIDILEELSKTDLIEKVWIHNKDLVINEFNIIKLYLSNKYPHDVKRNGTIRSKDILLIKEILDKYGSKNRLFTARSKSTTIPYKIKIDKDFARLMGYYLSEGWISKDYGRNGVVRKRIGLCFGIHEEEYINDVKNILNKLGIKYIEKIKDGSHSIIISSKILAYVFENILNCGINCYNKNIPPQIFNSKEEIKWEFLKGLFRGDGGIVRLNNDKNLNIEFATVSKKMAHSLLILLQSLGIVASVKKCYNNKSTTMAYIIRINGLEQVKKIGELFGRKWENYKDIVENYKRNIKPLGYSKSDNFAILEVKEIIKEHYSGYVYSVETENSLLITSYGILIHNC

SEQ ID NO: 207 - protein, 453 aa, Artificial sequence
  synthetic
NCLPADSDVLMADGTEKEIQEIEIGDSVVGSDSQQTSVAEVTNKWESEKEIREFSLADGTSLRSSADHRIMVGGDDAVDWKEGSEIESGDYVLKPRRLSVEETATPTLSDLIPIENQRYADKQSVSEFKTDLPYGAVSELADQFDVTTGTLHHPHTSVWTPKRCRDAASQYDVPVPDGGVEYRGTGVALERKITPEELYYAGLILTDGSMSTDDGVRFYNTREELHRQFPGENHLEPDGKGCYKQNVLDYATMYAFHGLGIPFGNKNDGPVDLSTIYEMPSEYIGRFLAGAIDGDGNIAQSGITVAAENRSIGTWYVKLFKRLGIYAQQRENVVRIPDAKRDIDRLKDCVLPYMSHSEKKDALTEFEGGKSGQTENIPYALFEADVGSDAKRIGNDKHRRGINLKRHETHSEEWEEYVFVEVTDVSVTGTETTYDIETTTHNFIAEGCLVHNC

SEQ ID NO: 208 - protein, 198 aa, Artificial sequence
  synthetic
GALYYFSEIQLPNGKEFIGKLVDELFEKYHDKIGKYKDMEYVELNEEDTFEVISIGPDLSARRHKVTHVWRRKVKDGEKLVKIRTASGKELVLTQDHPVFVLLGRDVARRDAGNVKVGDEIAVLNTRPDFSVLSPPAMPELLSEPFNYELSSIGDVAWDEVVEVDEIDAKGLGVEYLYDLTVDINHNYVANGIVVSNC

SEQ ID NO: 209 - protein, 457 aa, Artificial sequence
  synthetic
YCFPPTEEAVFKFGDKVKIATFEEVAKNFKFEHKVEIDGFKGEYSIPNDLYVLTFNDGKAEWTRVTKFLRRKHEGKIRVIKTKTGRTIRTTPEHKFFVYKDGELVKKRADELEPGDELVLLWRFESEETLTEINLLEAFKDLPQEEKEKVYVRGIKDLDLTPLKEKYGDKVYYWARQDSMPLSVFYELNVDLDKEFRLGRDATTYELPSKLKITPSLAKLIGYFVSDGNYSDKDLRITVGHEDVEKEIVNILEELGLPYSFLEWEGKTKQIVIGSRLLRLVFKHVFKIPEGAPNKRLPEGFLSFPFEAKVALLSGLFNGDGYVVRGEHHLSIGYASTSKGLIRDILYLLASLGIFARVYRVPKEKMKGANHDLYKLYIAGTDLVRLVELLELREGHREKLGEIGNRKPARVKKIADFYIDVVDEVSEEEYSGYVYDLEVENEGHSFVAADGILVSNC

SEQ ID NO: 210 - protein, 610 aa, Artificial sequence
  synthetic
SCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNC

SEQ ID NO: 211 - protein, 384 aa, Artificial sequence
  synthetic
PCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNC

SEQ ID NO: 212 - protein, 438 aa, Artificial sequence
  synthetic
NCLAPGSKVLTEHGYWLKVEELPEKFKLQGVKVYNLDEGHNDTSNVAFVAEREVETGEMAVRVTTESGRIIEGSEDHPVLTPEGYVYLGNLKEGNLVIVYPFEGVEYEERKGVILDEDAFKDEDPQVLSFLREKGLVPLRWDDPRIGTIARILGFAFGDGYLGEMGGRLTLTFYGKEETLRELKKDLERLGISANLYVRESIETTSGHSEGKSLSIELRVTSRSFALFLEKLGMPRGKKTEKAYRVPGWILEAPLWVKRNFLAGLFAADGSIVEFKGNTPLPINLTQSKSDELAENLVEFLGDVAKLLAEFGIETTLYEVKSKKGVTYRLSIVGEDSIRTFVERINYEYDPEKKVKGLIAAAYLKLKERIVKEAHEAVKDDFPTFEEFAKERGYEGGFVAEKVVKVERVKPEYTKFYDIGVYHEAHNFIANGIVVHNC

SEQ ID NO: 213 - protein, 394 aa, Artificial sequence
  synthetic
PCVTGDTRVLTRDGYLKISEVYKRAKERGELFLISEGVEKDGDPKGYAVHVVVPLLQVKTDGRTEQVAQLVKSGVLKVGTKDVYLVATKEGFEIKATGDHKLLVVNSLGEYEWRRVDELRPGDKLVVSMVDISRADIGEDTMPASVAYLLGRVVGDGSIIVDKHNRPHIYVYFSKEELEEALALIDMLKAEFGSDISYTLSEKRTEIALEISGTVARAITSMVPELIHLKRDKLVPEVIFESKPGIIRWFLRGLFDADGTIDRDYAIRLTSTSKRLLREVQQLLLLFGIYSVIYKRRRKGGVFKYVTKSGEERVYKSSEVYYELVIKNESRCRFMEKIGLSPRKSAKISLKKCKREKPFATVASVEYIGKEVVYDFGVPDYHRYIAEGIVSHNC

SEQ ID NO: 214 - protein, 524 aa, Artificial sequence
  synthetic
GALYDFSVIQLSNGRFVLIGDLVEELFKKYAEKIKTYKDLEYIELNEEDRFEVVSVSPDLKANKHVVSRVWRRKVREGEKLIRIKTRTGNEIILTRNHPLFAFSNGDVVRKEAEKLKVGDRVAVMMRPPSPPQTKAVVDPAIYVKISDYYLVPNGKGMIKVPNDGIPPEKAQYLLSVNSYPVKLVREVDEKLSYLAGVILGDGYISSNGYYISATFDDEAYMDAFVSVVSDFIPNYVPSIRKNGDYTIVTVGSKIFAEMLSRIFGIPRGRKSMWDIPDVVLSNDDLMRYFIAGLFDADGYVDENGPSIVLVTKSETVARKIWYVLQRLGIISTVSRVKSRGFKEGELFRVIISGVEDLAKFAKFIPLRHSRKRAKLMEILRTKKPYRGRRTYRVPISSDMIAPLRQMLGLTVAELSKLASYYAGEKVSESLIRHIEKGRVKEIRRSTLKGIALALQQIAKDVGNEEAWVRAKRLQLIAEGDVYWDEVVSVEEVDPKELGIEYVYDLTVEDDHNYVANGILVSNC

SEQ ID NO: 215 - protein, 483 aa, Artificial sequence
  synthetic
NCLAPGTKVLTEHGYWLKIEEMPEKFKLQRLRLYNIEEGHNDFSRVAFVAERNIEKDETAIRIVTETGTLIEGSEDHPVLTPQGYVYLKNIKEGDYVIVYPFEGVPYEEKKGIIIDESAFEGEDPQVIKFLKERNLLPLRWEDPKIGTLARILGFALGDGHLGEMGGRLVLAFYGREETLRELKKDLESLGIKANLYVREKNYRIKTESGEYSGKTVLAELRVSSRSFALLLEKLGMPRGEKTKKAYRIPVWIMEAPLWVKRNFLAGFFGADGSIVEFKGTTPLPIHLTQAKDVALEENLKEFLYDISRILEEFGVKTTIYKVNSKKSVTYRLSIVGEENIRNFLGKINYEYDPKKKAKGLIAYAYLKFKESVKKERRKAMEISKKIYEETGNIDRAYKAVKDIVNRRFVERTIYEGERNPRVPKNFLTFEEFAKERGYEGGFVAEKVVKVERIKPEYDRFYDIGVYHEAHNFIANGIVVHNC

SEQ ID NO: 216 - protein, 375 aa, Artificial sequence
  synthetic
FCLHPDTLILTSQGVRKIKELSREGEVFALDFNLKLSKAKYRLLERDADEQMYKVTLLDGTELYLTADHPVLVYREGNLAFVPADKLRETDHVVLVLNKSARDNYGFLDLLLEITDSQEDYAILENGETLSLHSLKMLVERGEIKDIAVVGFSHNNFGKVMLRDELWYLIGYLAGKGGEIKGNGVVISSRTKEIVGLTKSLNIDLIETEEGIVLSNKSFVRLLHLIHYTPRVPEVYGIINNTEWLKAFLAGYYDATLLEGLTLEALYKIKVYLQLLGIRAKIEDNKLKVHLEDLQRFRELLGKFSRRKLYVETSQVPVFTDFDERSYDFPRILGGDIYIIGIKSIEKFHYKGKVYDLVVENYHNFIANGIAVHNC

SEQ ID NO: 217 - protein, 522 aa, Artificial sequence
  synthetic
GALYDFSIIQLSNGRFVLIGDLVEELFKKYSDKIERYKDLEYIELNDEDRFEVVSVGPDLKANKHIVSRVWRRRVREGEKLIRIKTRTGNEVILTRSHPLFAFSNGDVVRKEAGNLKVGDRVAVMMNPPKPPQTKAVVDLSIYAKISDYYLVPNGKGMIKVPNKGLPPEKAQYLVSVNSHPVKLVREVDEKLSYLAGVILGDGYISSNGYYISATFDDEDYMEAFVSVISDFIPNYIPNVKENGKYMVVTVGSKIFAEMLSRIFGIPKGRKLEWDVPDIVLSNDDLMRYFIAGLFDADGYVDENSIILVTKSENVARKIWYALQRLGIISTVSRVKNKGFKEGEIFRVIISGVDDLAKFARSIPLHHSRKRAKLMEVLKTKKTHRGRRAYRVPISAEMIAPLRQMLGLTVSELSKLASHYAGEKVSESLIRHVEKGRVKEIRRSTLRGIALALQQVAKDVGDEEAWVKARRLQLIAEGDVYWDEVVSVEEVDPKELGIEYVYDLTVEDDHNYVANGILVSNC

SEQ ID NO: 218 - protein, 412 aa, Artificial sequence
  synthetic
LCVTPDTLVSLSDGRIIEIREAVENSEESLLGINGLKPKEAKALKFWEIDWDGPIKVIKLKNGHEIKATPDHGLLVMRDGKIGWVSAKNIREGDYVAFIYNLGHRGGKKYTLPQLLKELGISEYENSSSQELNNREQEMDSKQISIELDERFWYIFGVILGKGTLKGDKVVIFQKDVKPVIEEALPFVRIFESADHIGFSHLILAEVFRRLGVGEGKLHSLVFGLREEYINAMIAGYFDASGTFLRRAVLTSKRGDILRMLSVYLYQIGIVNNLRRDEHAGVWELIISDLEKFREKIYPYLRIKKSQFDKVYSISKNEGDFLPVASIFRKLKFRDGFKNRILDEEIPRDEVAKVLEYAEDSPEKEFLNSLVEARVTWVRVEKIEERHYTGKLYDFTTTTENFISNGIVSHNC

SEQ ID NO: 219 - protein, 387 aa, Artificial sequence
  synthetic
PCVVGDTRILTPEGYLKIEDLFRMAKERNNGEKVVAVEGIAEGGEEFAYPVAILLPNEEEKEVIYETVHGKQLAIADPIEVKAYVWKVGKKKVARIKTKEGYEIIATLDHKIMTKDGWKAVEDLKEGDLIVLPRFEVEDNFGSESIGEDLAFVLGWLIGDGYINTDDKRVWFYFNAEKEEEIAQKISEILKKRFNSKAEPHRYGSEIKLGVRGEAYKFFEKIVKTNDKRVPEIVYHLKPNEIRAFLRGLFTADGYVDNDGAIRLTSKSRELLRDVQDLLLLFGIISKIYERPYKGTFEYTTKEGEKKVYTAQGYYELVIANYSRKLFAEKIGFEGEKQKKIKLNKTKIDEPYARVESVEIIGEEIVYDLTVPGIHSYISNGFISHNC

SEQ ID NO: 220 - protein, 392 aa, Artificial sequence
  synthetic
NCLAPGTRVLTEHGYWLKIEEMPEKFKLQRLRVYNIEEGHNDFSKVVFVAEREVGSEEKAIRIVTESGKVIEGSEDHPVLTPEGYVYLRNVKEGDYILVYPFEGVPYEEKKGVILDESAFEGEDPQVVKFLRERNLIPLQWKDPKVGILARILGFALANGYISENDNLTFHGKEEVLREVRKDLEELGIEAIVAEEDKLKVTSREFAFLLEKLGMAHDSIPEWIIEGPLWIKRNFLAGLFGANGSIVEFKGDVPLPITLTHSRELLNDVSRILEGFKVRAKIKMGKNGSYQLVIEDEDSIRNFLGRINYEYDPEKKARGLIAYAYLKFKELMKGNLMTFEEFARDRGYEGGFVAEKVIEVKSVKPEYDKFYDIGVYHSAHNFIANGIVVHNC

SEQ ID NO: 221 - protein, 411 aa, Artificial sequence
  synthetic
LCLTGDTLITMADGSRKTIKEIVENDLIDEEILTLDLSDNGLKKGKITHCFDNGIKDVYKITLQNGLEIKATADHKFLTPFGWKTVRELQAEKDLLAVPVNVDVEGEESDEDKLRVLAYLLADGYLAKSSISFVNKDKTLIEAFKVSVERAFDNVSFKEFLRARDVWNIYIVSKERNRYHSNPLINWFKELGLFHKKSEEKFIPEFVFKLNKESISKFLAYYWDCDGYIGEKLAHIKTISKDLAYGLYYLLLRLGIKANIYKSYYDDKTSYQVTVYDLKNFKKYILPHMISQKARNLTREVSDNSFYLKDIALEKVKAFCEENGISQREFSRLTGIQRNNFFNGKQQFIKSSVIEKIAPVIEDEELLKLMDGDIGFVPIREIEYAGKEHVYDIEVEGTHNFIANNIISHNC

SEQ ID NO: 222 - protein, 406 aa, Artificial sequence
  synthetic
PCFVGSTRIPTEFGLVPIEELAKKGESFFLVTDRRAPYGGLGLPQTAQGTVVRKAARAFYTGVKPVVRLTTREGLELTLTPDHLLLTPEGYREAGSLKPGDRILVQSGEGLFPKEEALPAAVLEVVQERVATAGGRGRADIQAQYSHLPTRWSRELGVALGWLLGDGYLREDGVGFYFSRQDFAQVAWLPDLLRDWFGGGSLQDTHSNTYHLHFKRIPAEFFQALGVKPAKATEKRVPESLFRAPREAVVGFLQGLFSADGSVQINPGKQDATVRLASSSKGLLQDVQLLLLNLGIYGRIHKRREAGQKELPDGRGGLKAYPVAAQYELILGAENRDLFAEIVGFLQEEKQAKLLAFLQDRPKGSYHKPFLATVVGVEPAGEAPVYDLTEPVTHSLIANGIVAHNC

SEQ ID NO: 223 - protein, 154 aa, Artificial sequence
  synthetic
YCLSGETAVMTVEYGAVPIRRLVQERLSCHVYSLDGQGHLYTQPIAQWHFQGFRPVYEYQLEDGSTICATPDHRFMTTRGQMLPIEQIFQEGLELWQVAIAPRQALLQGLKPAVQMSGMKIVGRRLMGWQAVYDIGLAADHNFVLANGAIAANC

SEQ ID NO: 224 - protein, 525 aa, Artificial sequence
  synthetic
GALYDFSVIQLSNGKFVLIGDVVEELFNKYSDRIKTYKDLEYIELDPEDQFEVVSVGPNLKAGKHTVTAVWRRKVRNGEKLIRIRTRTGNEVILTKTHPFFVFSDGDVVRKEAEKVRPGDRVAVMMRPPKAPQSPAVVPVEVYAGISDYYLVPNGNGMKKVPNRGVPPEDAEYLLSRNSKPVKLVREVGTSLAYVAGVILGDGYLSSDGYNLSVTFDDPDYMNSFTSAMSEFLPESAPRIKDNGTSTVVTYGSRIFNEMLSRIFGIPRGKKSSIWDVPDVVLTNDDLMRYFIAGLFDADGSVDETGPAVILTTKSESAARKIWYALQRLGIISTVSRVRNRGFKEGHIFRVIISSVEDLKKFDALIPLSHSRKREKLKAILKEKRPYRGRYTYRVPISPEMIKPLRTRLNLTVAELSKLASKYAGETITESLIRHVEKGRTSEIRRSALKGIALALQRIAQDIGDEDAWVMAKRLELIADGDVYWDRVVEVEEVDPEEIGIEYLYDLTVDEDHNYVANGILLSNC

SEQ ID NO: 225 - protein, 491 aa, Artificial sequence
  synthetic
LCVTPDTLVSLADGRIMEIKDAVEKSEGNLLSVNGLKPKEAKALKFWEIDWNGPLKVIKLKNGHEIKATPDHGLLVMREGKLGWVSAKNVREGDYVAFAYNTGHRGRDEYTLLKLMIKLGITDVMVELDEEYFNEKVAPIVRERISTSTKYKYLRRRVLPLYLLQEWGLDDYEAHVKSLYRQRAGSKPIPNFKLDGRFWYVFGLVLGDGTLRDSKVLISQTPLKDVKSVLEDVFPFLRVFETTNQVGFSNSIIAEVFRRLGARKGKLHPLVFGLREEYINAMIAGYFDTDGTFSILNDRKGPNFRGILTSKRGDVLRMLSVYLYQIGIMNYLRRDERTGVWDLIISNRSLEKFREKIYPYLRIRRAQFDEAYSVYRASRRAFEGDLLPVAPVFGKLKFKNGTKNRILKETGIDVWNWLKRPEGEIPRDKLSKVLEYAEESPEKEFLKSLVEAGVTWVKVKGVEEELYTGKLYDFTTTTENFLSNGAVSHNC

SEQ ID NO: 226 - protein, 384 aa, Artificial sequence
  synthetic
PCVVGDTRVLTPEGYIKAEELFSLAKERGKKEAVAVEGIAEEGEPYAYSVEVLLPGEEEVKYETVHGKALAIADPVAVPAYVWKVGKKKVARVRTKQGYEITATLDHRLMTSEGWKEVGELKPGDEILLPRFEIEEDFGSESIGEDLAFVLGWFIGDGYLNVNDKRAWFYFNAEKEEDIAWKIREILAKHFGIKAEPHRYGNQIKLGVRGEAYRWLESIMGSNEKRVPEIIYRLKPREIAAFLRGLFSADGYVDNDNAVRLTSKDRGLLRDVQDLLLLFGILSKIYERPYSSEFKYTTKDGEERTYRAEGYYELVIANYSRKLFAEKIGFEGYKMEKLSLQKTKIDEPVVTVESVEVLGEEIVYDFTVPEHHSYISNGFMSHNC

SEQ ID NO: 227 - protein, 513 aa, Artificial sequence
  synthetic
YCLHPDSLIPTPQGVKRIKELPEKGEVFALDFDLKLSRARYRLLERDADEPMYKVTLSDRTELYLTADHPVLVYRDDQLIFVPAEELRENDQVVLFINRSEYSPRTESPTLLGFLLENATSMKDYILYDPEFGGVLRNRIKDAGLKTEILWRFRIREPTYYKYLRGKMPVPIVRFLLEEGVVSIEELREVFRGFSYSTSLTPISFEFSEEFWYLFGLVAGDGHLAKKGAITIPAKDRTEDTVKAVKEIANSLQVPFAFDEKYKMIILRSKSLTRLFELLGCPYGNKTEIFRIPGEIMAKPEWMAAFLAGYYDADGHIGTKPTGGKKSHSPQIVLTSKNRMAIYTVKQMWQLLGVGTYLWEKKDRNGNFMAYELKVYSRDAWRFYEVMKNHLRIKRKDLEHVKEVAIRKRKAYSHHYSVLNVKSWEGKIKSSNVLWKKFDMSNQTAHGRGISLDKLQRIVDYLTDTDLRRIAMGDVYVLGIRSIEKFHYRGKVYDLVVDQYHNFIANGVVVHNC

SEQ ID NO: 228 - protein, 525 aa, Artificial sequence
  synthetic
GALYDFSVIQLSNGKFVLIGDLVEELFKKYSDRIETYKDLEYIVLDEKDRFEVVSVGPDLKAGKHIVSRVWRRKVREGERLMRIKTRTGNEVILTKTHPFFVFSKGDVVRKEAEKLKVGDRVAVMMNPPKPPQRRAIVDPSIYVKISDYYLVPNGKGMVKIPNEGLPPEKVQYLSSVNSHHVKLVREVNEKLSYIAGVILGDGYISSGGYYISATFDDEDYMEAFVTAVSKFVPNYVPRMKNDGKSTVVTVGSKIFAEMLSRIFGIPKGKKSGIWDVPDVVLSNDELMRYFIAGLFDADGYVDKNGPSIILATKSENAARKIWYALQRLGIISTVSRVKNRGFKEGEIFRVIISGVEDLTKFAKFIPLCHSRKRAKLMEILNTKKAYRGRKTYRVPISSEMITPIRRRLGLTIAELSKLASYYAGEKVSEGLIRHIEKGRVREIRRSALKGIALALQQVAKDIGDKEAWVMGKRLQLLAEGDVYWDEVVSVEEVDPRELGIEYLYDLTVEDDHNYVANGILVSNC

SEQ ID NO: 229 - protein, 537 aa, Artificial sequence
  synthetic
ACLHPDSRVLVNGKYLPIKELFNEAKSYKAKSNGEIVDIQEDTFEVVSLDLERMKTGNSLATIIRRKQWKGELVKLKFRSGNELLLTPDHWLIDGKTLEWKEAGEFKPGDTVVAPLKLPEVKEKIYILDILPENWRVKLTKEEKEELRKEVLRRFKSIAEFNRHYGISKDFLSGRGAIKVGKFRKILKDFGIYEKWKKRHLAYGPYSRREKLKVAYITPEMAYFFGFLYGDGWIQRIGDRVTLRITQSLVNEKQLKRLRESFALFYPKKLREYRRTTSSILAGNKISSESITFSVNSPLLGYIYEYLTKDNLTNLFGLDDEALKAFVAGALDSDGCVSIKRSDKGEVVHVEFLLSNDIRKDNAFAMLLRRFDVYARIVRDKRENVNRIQITSREDVKNLLEAVKSYSIKVKEIPEVKRLISPKSDKLPSEPVKEIARRIREEIPASILLEKGLWSVIYEYSKGVRVPTRKQIHKLLERLSDYLSPEIKFKLEILARRDYFLDEIVEVERIPYEGHVYDLYVPVYHNFVAEGIIVHNC

SEQ ID NO: 230 - protein, 610 aa, Artificial sequence
  synthetic
SCVTGDTRIYTPDEREVKIKDFLKFYERGLVREVSNRNGRDTVIAAVAFNSKIIGHPVFRLTLESGRVIEATGDHMFLTPAGWVQTYDLKEGSEVLVKPTLEGTPYEVNPEPIVDLRDFYEFANKLELERGRKPLGEARNFRELTTKDKEKILARALELKAEMEKGLTEREAEILQEISTEWTSREEIQKKVGLSRARLNQLLKNLEEKGYVERRMEGKRQFVRKLRDGVPLRNTADVKRILEKELGIKISYTAVKRLLAGELDGPAYNLLRELKKRWLVRYDDERAGILARVLGFLLGDGHLAKGGTRVWFNSSREELEALAEDLRRLGLKPSEIIERESSSEIGGRKVKGKIHMLYVDNRALHALMRFWGVEAGNKTKKGYRVPEWIRKGNLFVKREFLRGLFAADGTKPYSEKYNFNGIKLEMRTSSESLEETTEFFNDLAELLREFEVDSKVIVSPIGDGFIVRLVVTPNESNYLKFLTRVGYAYVKDKYARLVGEYLRMKLTYKEIILPQIAEKAVELAAKTNPTQAAKLLGVKRDFVVNRLNGVPIGLTRDFMTFEDFRRERVTGDYVVEKVIKKEELGYLDVYDVTCASDHSFISNGLVSHNC

SEQ ID NO: 231 - protein, 386 aa, Artificial sequence
  synthetic
PCVVGDTRVLTPEGYLKIEELFRIAKERNEEKVVAVEGIAEEGEEFAYPITILLPNEEEKEVIYETAHGKQLAVADPIETKAYVWKVGRKKVARVKTKEGYEITATLDHKIMTKDGWKAVEELKEGDLIALPRFEIEDDFGSESIGEDLAFALGWFIGDGYINTNDKRVWFYFNAEKEEEMAHKISEILKKHFNSKAEPHKYGSEIKLGVRGEAYRFFEKIVKTNEKRVPEIVYRLKPNEIRAFLRGLFTADGYVDNDSAIRLTSRDRELLRDVQDLLLLFGILSKIYERPYKGTFEYTTKDGEKKIYEAQGYYELVIANYSRKLFAEKIGFEGEKQEKIRLNKTKIDEPYARVDSVEFIGEEIVYDLTVPEIHSYVSNGFMSHNC

SEQ ID NO: 232 - protein, 513 aa, Artificial sequence
  synthetic
YCLHPDSLIPTPQGIKRIRELPKEGEVFALDFDLKLSKAGYKLLERDADEPMYKVTLTDRTELYLTADHPVLVYRDDKLMFVPAEELREDDQVVLLINRDKPPENEEPPTLLDFLLESAVSMKDYIIYDREFGEIIKKRVKSASLKTEILRKFRIKEPTYYKYLRGKIPVPLVKFLLQRGIISDSELRRTFKGFSYSTATTPIAFEFSEDFWYLFGLVVGDGHLNRRGEITISAKERTKDTIEAVKSVTNSLGLSFAFNPKYRIIAINNKSLTRLLELLGCPSGNKTEIFRIPGIIMARPEWMAAFLAGYYDADSHIGTKQTGSKKSLSPQIVLTSKNREAIYTVKLMWQFLGVGTYLWEKKDKNGGIIAYELKIYSRDAQRFYEIMKDRLRIKRRDLESVKDTAIRERKPYSHHYSLIKVKSWEGKILSTNALWKSFDMSNQTAHGRRISLDKLRSIVRYLIDQDLRRIATGDVYILGIKSIEKFHYRGKVYDLVVNTYHNFIANGVVVHNC

SEQ ID NO: 233 - protein, 483 aa, Artificial sequence
  synthetic
NCLAPGSKVLTEHGYWIKVEEMPEKFKLQGLRVYDVDEGHNDFSQVAFVAERDVEENELAVRIITESGKVIEGSEDHPVLTPQGYVYLGNVKEGDEVLIYPFEGVEFEERKGVLLSEDDFKGEDGQIVKFLRERKLLPLRWDDPRIGTLARILGFAFGDGHLGEMDGRLYLSFYGKEETLKELKKDLERLGISANLYVRERDYHIETVSGEYEGRSVSAELRVTSRSFALLMEKLGMPRGRKAETLYNVPEWIKSAPLWVKRNFLAGLFAADGSIVEFKGNTPLPINLTQSKAEALEENLRGFMEEIAGLLAEFGIRTTVYRVKSKKGVTYRLALVGEESIRNFLGRINYEYDIEKKAKGLIAYAYLRFKERVRAERKRAAEIARRVYAETGSVAKAHEAVRDVVNKRFVERAIYEGEKEPRVPKDFPTFEEFARERGYEGGFVAEKVVKVERVRPSYEKFYDIGVYHRAHNFIANGVVVHNC

SEQ ID NO: 234 - protein, 376 aa, Artificial sequence
  synthetic
PCVTGDTWVMTTEGPKQVNDLIGKPFEAVINGRFYRTTNEGFFKTGHKHIVLVETIEGYSIRLTDDHKILKVVDSSLNEMKTEWVSAIELKPGDKIILNNNRNLIGWSGELDEGDGYLLGLLVGDGVLKRDTAILSVWKEGKAVGDVNNCGVDNVMQYALDCAMRLPHRRDFTGWMEIKGRNEYRLKLASLRDLALKMGMHNGFKTVTPELEKMSSSAYIGFIRGLFDCDASVQGSPEKGASIRLAQSDLDLLKAVQRMLLRLGIVSKIYVNRRKASMKLMPDGKGSLKEYKIKPQHELCISGDNIEIYAKRIGFQDLKKMHRLNTLLSSYKKGSHQERFVARVLDIKESGFEDVYDVQVPGINSFDANGIIIHNC

SEQ ID NO: 235 - protein, 409 aa, Artificial sequence
  synthetic
PCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGPGTLQETRSNTFHLHFNRIPAEFFQALGVKAARATEKRVPESLFRAPREAVVGFLQGLFSADGSVQINENKQDATVRLASSSLALLQDVQLLLLNLGILGKIHKRREAARKALPDGKGGLREYPVAPQYELILGGENRDRFAEVVGFLQEEKQSKLLAFLRHRPRGSYRKPFLATVASVEPAGEAPVYDLTEPVTHSLIANGLVAHNC

SEQ ID NO: 236 - protein, 409 aa, Artificial sequence
  synthetic
PCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGQGTLQETRSDTFHLHFNRIPAEFFQALGLKAARATEKRVPESLFRAPREAVVGFLQGLFSADGSVQINEKKQDATIRLASSSLALLQDVQLLLLNLGILGKIHKRREAARKALPDGKGALREYPVAPQYELILGGENRDRFAEVVGFLQEEKQSKLLAFLRHRPRGSYRKPFLATVASVEPAGEAPVYDLTEPVTHSLIANGLVAHNC

SEQ ID NO: 237 - protein, 154 aa, Artificial sequence
  synthetic
YCLSGETAVMTVEYGAIPIRRLVQERLICQVYSLDPQGHLYTQPIAQWHFQGFRPVYAYQLEDGSTICATPDHRFMTTSGQMLPIEQIFREGLELWQVAIAPPGALAQGLKPAVQMSCMKIVGRRLVGWQAVYDIGLAGDHNFLLANGAIAANC

SEQ ID NO: 238 - protein, 436 aa, Artificial sequence
  synthetic
YCFTGNTEISTDRGLFKIKDIVEKHIECRVYDYAGNFSPIKKYYKRETSSLLEIRPFLHSDAISCTLNHEFFVYNSKANEFIKKEAQYINVKEDYLVITIPQKEIFNYKLDVNNAIEDLYQELTFKQRFSNEEVIREVKELRKRGFSWRKIFKRFNLTDHLRRVIERKEALDSKILPIVKERDGKVAVKGSNFFIDKFIEVTPKFTRLLGYYLSEGCSSKDIGRKNSYYVSFTFNSKEKEYIRDTKEIFSETFKTELKEVESKKCKTLSLVSYKGIIGLFFKYYFGEDVYNKKLPTEFIYLDKDLQKQLIIGLFRGDGLTSPDFIKKYKKQRIQITSKLLRYQISLILLRLGIKYSIFRKEIIISDKRIFDLLGQSHLITKKVINTSNRYGFLDDKHLYLKINSVKKLNKKTKVYNLEIDNPTHSYNVNLISVSNC

SEQ ID NO: 239 - protein, 309 aa, Artificial sequence
  synthetic
PCVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLFDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHNC

SEQ ID NO: 240 - DNA, 55 bp, Artificial sequence
  synthetic
ggaattccatatgcgtggtatgctgccgctgtttgaaccgaaaggtcgtgtcctc

SEQ ID NO: 241 - DNA, 36 bp, Artificial sequence
  synthetic
acgcgtcgacttattactccttggcggagagccagt

SEQ ID NO: 242 - DNA, 896 bp, Artificial sequence
  synthetic
ggccggccaccccttcaacctcaactcccgggaccagctggaaagggtcctctttgacgagctagggcttcccgccatcggcggttgcatagacggaaaggccaagataatctttgagaacgaaggtgaggagcatctaacgacgatggaggagatgtacgagagatacaagcatctaggtgaattctacgatgaggaatacaatagatggggaattgatgtttcaaacgttcctatttatgtaaagtcattcgatccagagagtaagagagtcgtcaaaggtaaggtgaatgtgatatggaagtacgagcttgggaaggatgttactaagtacgaaatcattaccaacaaggggactaagatactaacatctccctggcatccgttcttcgttctgacacctgactttaagatagtggagaagagggctgatgagctcaaggaaggagacattttaatcggcggaatgccagatggctctggtcatcaccatcaccatcacggttctggtctcgaagttgtgaggcatataacaaccacgaacgagccgaggacgttctacgatctaaccgttgaaaactaccagaactatttggcgggagaaaatggaatgattttcgtccacaacaccggtaaaaccggcaagcgctccaccagcgccgccgtcctggaggccctccgcgaggcccaccccatcgtggagaagatcctgcagtaccgggagctcaccaagctgaagagcacctacattgaccccttgccggacctcatccaccccaggacgggccgcctccacacccgcttcaaccagacggccacggccacgggcaggctaagtagctccgatcccaacctccagaacatccccgtccgcaccccgcttgggcagaggatcc

SEQ ID NO: 243 - DNA, 43 bp, Artificial sequence
  synthetic
ggaattccatatgattttagatgtggattacataactgaagaa

SEQ ID NO: 244 - DNA, 45 bp, Artificial sequence
  synthetic
ccgctcgagttattaggattttttaatgttaagccaggaagttag

SEQ ID NO: 245 - DNA, 939 bp, Artificial sequence
  synthetic
aagcttgccaattatgaaattccaccagagaagctcgcaatatatgagcagataacaagaccattacatgagtataaggcgataggtcctcacgtagctgttgcaaagaaactagctgctaaaggagttaaaataaagccaggaatggtaattggatacatagtacttcgtggtggcggttgcatagacggaaaggccaagataatctttgagaacgaaggtgaggagcatctaacgacgatggaggagatgtacgagagatacaagcatctaggtgaattctacgatgaggaatacaatagatggggaattgatgtttcaaacgttcctatttatgtaaagtcattcgatccagagagtaagagagtcgtcaaaggtaaggtgaatgtgatatggaagtacgagcttgggaaggatgttactaagtacgaaatcattaccaacaaggggactaagatactaacatctccctggcatccgttcttcgttctgacacctgactttaagatagtggagaagagggctgatgagctcaaggaaggagacattttaatcggcggaatgccagatggctctggtcatcaccatcaccatcacggttctggtctcgaagttgtgaggcatataacaaccacgaacgagccgaggacgttctacgatctaaccgttgaaaactaccagaactatttggcgggagaaaatggaatgattttcgtccacaacaccggtaaaattagcaatagggcaattctagctgaggaatacgatcccaaaaagcacaagtatgacgcagaatattacattgagaaccaggttcttccagcggtacttaggatattggagggatttggatacagaaaggaagacctcagataccaaaagacaagacaagtcggcctaacttcctggcttaacattaaaaaatcctaataactcgag

SEQ ID NO: 246 - DNA, 58 bp, Artificial sequence
  synthetic
cgaacgatgtgaacctaataacgtctctcgcggccgatctgccggccgcgagagacgt

SEQ ID NO: 247 - DNA, 58 bp, Artificial sequence
  synthetic
tgttctcctcttccgctgctcccgcgatctgccgcgggagcagcggaagaggagaaca

SEQ ID NO: 248 - DNA, 22 bp, Artificial sequence
  synthetic
ctcttgccatcggatgtgccca

SEQ ID NO: 249 - DNA, 24 bp, Artificial sequence
  synthetic
ccagtgtggctggtcatcctctca

SEQ ID NO: 250 - DNA, 26 bp, Artificial sequence
  synthetic
ggtgatcgcggtcagataaatagaga

SEQ ID NO: 251 - DNA, 26 bp, Artificial sequence
  synthetic
cagagaggaggttgccaataaggcta

SEQ ID NO: 252 - DNA, 27 bp, Artificial sequence
  synthetic
atggtccataccttagatgcgttagca

SEQ ID NO: 253 - DNA, 28 bp, Artificial sequence
  synthetic
gtcgacgagaacgaactgagtaaagtta

The invention claimed is:

1. A fusion protein comprising a target DNA polymerase and an intein, wherein the intein is inserted at a designated position in the target DNA polymerase, wherein insertion of the intein at the designated position in the target DNA polymerase inhibits activity and/or exonuclease activity of the target DNA polymerase, wherein the fusion protein comprises an amino acid sequence having at least 80% sequence identity with SEQ ID NO: 1 or SEQ ID NO: 10.

2. The fusion protein of claim 1, wherein protein splicing activity of the intein is regulated by one or more factors, and wherein activation of protein splicing results in release of the target DNA polymerase from the fusion protein, wherein the released target DNA polymerase possesses increased polymerase activity and/or increased exonuclease activity compared to the target DNA polymerase when present in the fusion protein.

3. The fusion protein of claim 1, wherein the intein comprises an amino acid sequence having at least 80% sequence identity with SEQ ID NO: 5.

4. A method of amplifying a nucleic acid template comprising providing a composition comprising the fusion protein of claim 1, and the nucleic acid template.

5. The method of claim 4, wherein the amplification method is selected from polymerase chain reaction (PCR), reverse-transcription PCR (RT-PCR), heat-treatment RT-PCR, isothermal amplification, reverse transcription, or sequencing.

6. The method of claim 5, wherein the RT-PCR is one-step RT-PCR or two-step RT-PCR.

* * * * *